United States Patent
Bell, III et al.

(10) Patent No.: US 9,481,869 B2
(45) Date of Patent: *Nov. 1, 2016

(54) HOST CELL MODIFICATION WITH ARTIFICIAL ENDOSYMBIONTS

(71) Applicant: BELL BIOSYSTEMS, INC., Palo Alto, CA (US)

(72) Inventors: Caleb B. Bell, III, San Mateo, CA (US); Alexey Bazarov, Fremont, CA (US); Abdul Wakeel, Fremont, CA (US); Joyce Barrozo, San Bruno, CA (US)

(73) Assignee: Bell Biosystems, Inc., Palo Alto, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 14/476,584

(22) Filed: Sep. 3, 2014

(65) Prior Publication Data

US 2015/0064787 A1 Mar. 5, 2015

Related U.S. Application Data

(60) Provisional application No. 61/873,308, filed on Sep. 3, 2013.

(51) Int. Cl.
| | | |
|---|---|---|
| C12P 21/02 | (2006.01) | |
| C12N 15/87 | (2006.01) | |
| C12N 5/16 | (2006.01) | |
| C12N 5/00 | (2006.01) | |
| C12N 15/02 | (2006.01) | |
| C12N 15/09 | (2006.01) | |

(52) U.S. Cl.
CPC .............. *C12N 5/16* (2013.01); *C12N 15/87* (2013.01); *C07K 2319/034* (2013.01); *C12N 2510/00* (2013.01)

(58) Field of Classification Search
None
See application file for complete search history.

(56) References Cited

U.S. PATENT DOCUMENTS

| | | | |
|---|---|---|---|
| 4,385,119 A | 5/1983 | Blakemore | |
| 4,677,067 A | 6/1987 | Schwartz et al. | |
| 5,843,643 A | 12/1998 | Ratner et al. | |
| 6,004,815 A | 12/1999 | Portnoy et al. | |
| 6,287,556 B1 | 9/2001 | Portnoy et al. | |
| 6,436,694 B1 | 8/2002 | Tally et al. | |
| 6,599,502 B2 | 7/2003 | Portnoy et al. | |
| 7,390,646 B2 | 6/2008 | Andino-Pavlovsky et al. | |
| 7,470,427 B2 | 12/2008 | Cocking | |
| 7,754,221 B2 | 7/2010 | Szalay et al. | |
| 8,021,662 B2 | 9/2011 | Szalay et al. | |
| 8,159,224 B2 | 4/2012 | Fontius | |
| 8,361,437 B2 | 1/2013 | Sharma et al. | |
| 8,406,498 B2 | 3/2013 | Ortyn et al. | |
| 8,828,681 B2 | 9/2014 | Bell, III et al. | |
| 8,859,281 B2 | 10/2014 | Bell, III et al. | |
| 8,956,873 B2 | 2/2015 | Bell, III et al. | |
| 2002/0012698 A1 | 1/2002 | Bauerlein et al. | |
| 2004/0234455 A1 | 11/2004 | Szalay | |
| 2005/0069491 A1 | 3/2005 | Szalay et al. | |
| 2007/0202572 A1 | 8/2007 | Szalay et al. | |
| 2007/0258886 A1 | 11/2007 | Ahrens et al. | |
| 2007/0275924 A1 | 11/2007 | Khan | |
| 2009/0181101 A1 | 7/2009 | Rademacher et al. | |
| 2009/0311194 A1 | 12/2009 | Hu et al. | |
| 2009/0325258 A1 | 12/2009 | Matsunaga et al. | |
| 2010/0135912 A1 | 6/2010 | Gambhir et al. | |
| 2010/0297022 A1 | 11/2010 | Prato et al. | |
| 2011/0034753 A1 | 2/2011 | Dobson et al. | |
| 2012/0021517 A1 | 1/2012 | Jin et al. | |
| 2012/0184004 A1 | 7/2012 | Kay et al. | |
| 2012/0184030 A1 | 7/2012 | Dermanovic et al. | |
| 2012/0302819 A1 | 11/2012 | Alphandery | |
| 2013/0183758 A1 | 7/2013 | Bell, III et al. | |
| 2013/0224122 A1 | 8/2013 | Gambhir | |
| 2013/0253303 A1 | 9/2013 | Bell, III et al. | |
| 2013/0280173 A1 | 10/2013 | Neeman et al. | |
| 2014/0273203 A1 | 9/2014 | Bell, III et al. | |
| 2015/0007359 A1 | 1/2015 | Bell, III et al. | |
| 2015/0010937 A1 | 1/2015 | Bell, III et al. | |
| 2015/0064787 A1 | 3/2015 | Bell, III et al. | |

FOREIGN PATENT DOCUMENTS

| | | |
|---|---|---|
| EP | 1807517 B1 | 10/2011 |
| WO | WO 2010/109187 | 9/2010 |
| WO | WO 2010/111409 | 9/2010 |
| WO | WO 2013/106814 | 7/2013 |
| WO | WO 2013106814 | 7/2013 |
| WO | WO 2014/039768 | 3/2014 |

(Continued)

OTHER PUBLICATIONS

Yan et al, Magnetotactic bacteria, magnetosomes and their application, May 9, 2012, Microbiol. Res. vol. 167, pp. 507-519.
Komeli et al., Molecular mechanisms of compartmentalization and biomineralization in magentotactic bacteria, 2012, FEMS Microbiol Rev. vol. 36, pp. 232-255.
Bazylinski et al, Magnetosome formation in prokaryotes, 2004, Nature Reviews vol. 2, pp. 217-230.
Bell, Tracking cardiac engraftment and viability of MiPSC by MRI, 2014, Abstract for Grant Application, Project No. 1R43EB019239-01.
Brewer, et al., Relaxometry of Bacterially Derived Organelles: A Novel Class of MRI Contrast Agent for Cell Labeling and Tracking, May 2014, Joint Ann Mtg ISMRM-ESMRMB, Italy.
Chen et al, Microwave breast tumor detection and size estimation using contrast-agent-loaded magnetotactic bacteria, 2013, 35th Ann Intl Conf IEEE EMBS Jul. 3, 2013, pp. 5781-5784.

(Continued)

*Primary Examiner* — Nancy J Leith
(74) *Attorney, Agent, or Firm* — HelixIP

(57) ABSTRACT

The present invention is directed generally to host cells with artificial endosymbionts, wherein the artificial endosymbiont and the host cell communicate with each other to alter a phenotype of the host cell. In some embodiments, the communication comprises the secretion of a polypeptide from the artificial endosymbiont into the host cell. The secreted polypeptide can be a selectable marker, a reporter protein, a transcription factor, a signal pathway protein, a receptor, a growth factor, a cytokine, an effector molecule or other factors that can produce a phenotype in the host cell.

28 Claims, 35 Drawing Sheets

(56) References Cited

FOREIGN PATENT DOCUMENTS

WO   WO 2014145785   9/2014
WO   WO 2015034962   3/2015

OTHER PUBLICATIONS

Frederickson et al, Inhibition of endosomal/lysosomal degradation increases the infectivity of HIV, 2002, J Virol vol. 76, pp. 11440-11446.
Goldhawk et al, Using the magnetosome to model effective gene-based constrast for magnetic resonance imaging, 2012, WIREs Nanomed Nanobiotch vol. 4, pp. 378-388.
Hautot et al, Preliminary observsation of elevated levels of nanocrystalline iron oxide in the basal . . . 2007, Biochim Biophys Acta vol. 1772, pp. 21-25.
Jogler et al, Genetic analysis of magnetosome biomineralization, 2006, Microb Monogr pp. 133-161.
Katzmann et al, Loss of actin-like protein MamK has pleiotropic effects on magnetosome formation . . . 2010, Molc Microb vol. 77, pp. 208-224.
Kirschvink et al., Biogenic magnetite as a basis for magnetic field detection in animals, 1981, Biosystems vol. 13, pp. 181-201.
Kirschvink et al., Magnetite biomineralization in the human brain, 1992, Proc Natl Acad Sci vol. 89, pp. 7683-7687.
Komeli et al., Molecular mechanisms of magnetosome formation, 2007, Ann. Rev. Biochem. vol. 76, pp. 351-366.
Komeli, Molecular mechanisms of compartmentalization and biomineralization in magentotactic bacteria, 2012, FEMS Microb Rev vol. 36, pp. 232-255.
Mannucci et al., Magnetic nanoparticles from Magnetospirillum gryphiswaldense increase the efficacy of thermotherapy . . . 2014, PLoS ONE vol. 9, e108959.
Matsunaga et al, Production of luciferase-magnetic particle complex by recombinant . . . AMB-1, 2000, Biotechnol Bioengin vol. 70, 704-709.
Pradel et al, Biogenesis of actin-like bacaterial cytoskeletal filaments destined for prokaryotic . . . 2006, Proc Natl Acad Sci vol. 103, pp. 17485-17489.
Staniland et al., Controlled cobalt doping of magnetosomes in vivo, 2008, Nature Nanotechnol vol. 3, pp. 158-162.
Tapper et al, Role of lysosomal and cytosolic pH in the regulation of macrophage lysosomal enzyme secretion, 1990, Biochem J vol. 272, pp. 407-414.
Team:NYMU-Taipei-2011.igem.org screenshots of web-site.
Tweten, Cholesterol-dependent cytolysins, a family of versatile pore-forming toxins, 2005, Infect Immun vol. 73, pp. 6199-6209.
Vadia et al., The pore-forming toxin listerolysin O mediates a novel entry pathway of L. monocytogenes into human hepatocytes, 2011, PLoS Pathog vol. 7, e1002356.
Wakeel et al, An Ehrlichia chaffeensis tandem repeat protein interacts with multiple host targets in cell signaling . . . 2009, Infect Immun vol. 77, pp. 1734-1745.
Wakeel et al, Ehrlichia chaffeensis tandem repeat proteins and Ank200 are type 1 secretion system substrates . . . 2011, Front Cell Infect Microb vol. 1, pp. 1-19.
Zurkiya et al, MagA is sufficient for producing magnetic nanoparticles in mammalian cells, making it an MRI reporter, 2008, Magn Reson Med vol. 59, pp. 1225-1231.
U.S. Appl. No. 90/008,867, filed Oct. 7, 2008, Portnoy, Daniel A. et al.
U.S. Appl. No. 90/008,859, filed Sep. 30, 2008, Portnoy, Daniel A. et al.
U.S. Appl. No. 90/008,860, filed Oct. 14, 2008, Portnoy, Daniel A. et al.
Agapakis, C.M. et al., Towards a synthetic chloroplast, PLoS ONE, Apr. 2011, 6: e18877.
Ben-Haim, N. et al., Cell-specific integration of artificial organelles based on functionalized polymer vesicles, Nano Lett., 2008, 8:1368-1373.
Benoit, M.R. et al., Visualizing implanted tumors in mice with magnetic resonance imaging using magnetotactic bacteria, Clin. Canc. Res., Aug. 15, 2009, 15(16):5170-5177.
Benoit, M.R. et al., Supp. Figs., Clin. Canc. Res., 2009, at: http://clincancerres.aacrjournals.org/content/suppl/2009/08/11/1078-0432.CCR-08-3206.DC1/Supplementary_Data.pdf.
Bernsen, M.R. et al., Labelling of mammalian cells for visualisation by MRI, Eur. Radiol., 2010, 20: 255-274.
Bhattacharya, D. et al., Photosynthetic eukaryotes unite: endosymbiosis connects the dots, BioEssays, 2003, 26:50-60.
Bielecki, J. et al., Bacillus subtilis expressing a haemolysin gene from Listeria monocytogenes can grow in mammalian cells, Nature, May 10, 1990, 345:175-176.
Bitterman, P.B. et al., Alveolar macrophage replication, J. Clin. Inv., Aug. 1984, 74: 460-469.
Blakemore, R., Magnetotactic bacteria, Science, Oct. 24, 1975, 190(4212): 377-379.
Blakemore, R.P. et al., Isolation and pure culture of a freshwater magnetic spirillum in chemically defined medium, J. Bacteriol. Nov. 1979, 140(2): 720-729.
Bonnett, H.T., On the mechanism of the uptake of Vaucheria chloroplasts by carrot protoplasts treated with polyethylene glycol, Planta, 1976, 131: 229-233.
Brown, M.B. et al., Exploiting tumour hypoxia in cancer treatment, Nat. Rev. Cancer, Jun. 2004, 4: 437-447.
Budde, M.B. et al., Magnetic tagging of therapeutic cells for MRI, J. Nucl. Med., Feb. 2009, 50(2): 171-174.
Bulte, J.W.M., In vivo MRI cell tracking: clinical studies, AJR Am. J. Roentgenol., Aug. 2009, 193(2): 314-325.
Burdette, D.L. et al., Vibrio VopQ induces PI3-kinase-independent autophagy and antagonizes phagocytosis, Mol. Microbiol., 2009, 73(4): 639-649.
Burgess, J.G. et al., Evolutionary relationships among Magnetospirillum strains inferred from phylogenetic analysis of 16S rDNA sequences, J. Bacteriol., 1993, 175: 6689-6694.
Camilli, A. et al., Listeria monocytogenes mutants lacking phosphatidylinositol-specific phospholipase C are avirulent, J. Exp. Med., Mar. 1991, 173: 751-754.
Cao, F. et al., In vivo visualization of embryonic stem cell survival, proliferation, and migration after cardiac delivery, Circulation, 2006, 113:1005-1014.
Cheng, K. et al., Magnetic enhancement of cell retention, engraftment, and functional benefit . . . , Cell Transplant., 2012, 21: 1121-1135.
Chico-Calero, I. et al., Hpt, a bacterial homolog of the microsomal glucose-6-phosphate translocase . . . , Proc. Natl Acad. Sci., Jan. 8, 2002, 99(1): 431-436.
Chomel, B.B. et al., Ecological fitness and strategies of adaptation of *Bartonella* species to their hosts and vectors, Vet. Res., 2009, 40: 29.
Cocking, E.C., et al., Symbiosome-like intracellular colonization of cereals and other crop plants by nitrogen-fixing bacteria . . . , Chin. Acad. Sci., 2005, 48: 888-896.
Cocking, E.C., et al., Intracellular colonization of roots of arabidopsis and crop plants by Gluconacetobacter diazotrophicus, In Vitro. Cell. Dev. Biol., 2006, 42: 74-82.
Concord, C. et al., Long-term evolutionary stability of bacterial endosymbiosis in Curculionoidea . . . , Mol. Biol. Evol., 2008, 25(5): 859-868.
Corchero, J.L. et al., Biomedical applications of distally controlled magnetic nanoparticles, Trends Biotechnol., 2009, 27(8): 468-476.
Dale, C. et al., The insect endosymbiont Sodalis glossinidius utilizes a type III secretion system for cell invastion, Proc. Natl Acad. Sci., Feb. 13, 2001, 98(4): 1883-1888.
Dang, L.H., et al., Combination bacteriolytic therapy for the treatment of experiemental tumors, Proc. Natl Acad. Sci., Dec. 18, 2001, 98(26): 15155-15160.
Dubreuil, R. et al., Bringing host-cell takeover by pathogenic bacteria to center stage, Cell. Logist., 2011, 1(4): 120-124.
Dyall, S.D. et al., Ancient invasions: from endosymbionts to organelles, Science, 2004, 304: 253-257.
Faivre, D. et al., Magnetotactic bacteria and magnetosomes, Chem. Rev. 2008, 108: 4875-4898.

(56) References Cited

OTHER PUBLICATIONS

Felfoul, O. et al., MR imaging of Fe—Co nanoparticles, magnetotactic bacteria . . . , Proc. of the 7th IEEE International. Conf. on Nanotech., 2008, pp. 308-1.

Finlay, B.B. et al., Common themes in microbial pathogenicity revisited, Microbial. Mol. Biol. Rev., Jun. 1997, 61(2): 136-169.

Fritsche, T.R. et al., Phylogenetic diversity among geographically dispersed Chiamydiales endosymbionts . . . , Appl. Environ. Microbiol., Jun. 2000, 66(6): 2613-2619.

Goebel, W. et al., Intracellular survival strategies of mutualistic and parasitic prokaryotes, Trends Microbiol., Jun. 2001, 9(6): 267-273.

Goetz, M. et al., Microinjection and growth of bacteria in the cytosol of mammalian host cells, Proc. Natl Acad. Sci., Oct. 9, 2001, 98(21): 12221-12226.

Gordon, S. et al., Monocyte and macrophage heterogeneity, Nat. Rev., Dec. 2005, 5: 953-964.

Gupta, R.S. et al., Phylogenomics and signature proteins for the alpha Proteobacteria and its main groups, BMC Microbiol., Nov. 28, 2007, 7:106.

Hackam, D.J. et al. Rho is required for the initiation of Calcium signaling and phagocytosis by Fcy receptors in macrophages, J. Exp. Med., Sep. 15, 1997, 186(6): 955-966.

Hacker, H. et al., Caspase-9/-3 activation and apoptosis are induced in mouse macrophage upon ingestion and digestion of *E. coli* bacteria, J. Immunol., 2002, 169: 3172-3179.

Hayward, R.D. et al., Direct nucleation and bundling of actin by the SipC protein of invasive *Salmonella*, EMBO J., 1999, 18(18): 4926-4934.

Himmerlreich, U. et al., Stem cell labeling for magnetic resonance imaging, Min. Inv. Ther., 2008, 17:132-142.

Hong, P.C. et al., Identification of genes required for chronic persistence of *Brucella abortus* in mice, Infect. Immun., Jul. 2000, 68(7): 4102-4107.

Huang, J. et al., Phylogenomic evidence supports past endosymbiosis, intracellular and horizontal gene transfer in *Cryptosporidium parvum*, Genome Biol., Oct. 19, 2004, 5:R88.

Joseph, B. et al., Identification of *Listeria monocytogenes* contributing to intracellular replication by expression profiling . . . , J. Bacteriol., Jan. 2006, 188(2): 556-68.

Judas, M. et al., Genomic islands tools of bacterial horizontal gene transfer and evolution, FEMS Microbiol. Rev., 2009, 33: 376-393.

Jutila, M.A. et al., Locally dividing macrophages in normal and inflamed mammary glands, Clin. Exp. Immunol., 1986, 66: 615-624.

Kasinaskas, R.W. et al., *Salmonella typhimurium* lacking ribose chemoreceptors localize in tumor quience and induce apoptosis, Cancer Res., 2007, 67(7): 3201-3209.

Kawaguchi, R. et al., Phylogeny and 16s rRNA sequence of *Magnetospirillum* sp. AMB-1, an aerobic magnetic bacterium, Nucleic Acids, Res., 1992, 20(5): 1140.

Kimura, N.T. et al., Selective localization and growth of *Bifidobacterium bifidum* in mouse tumors following intravenous administration, Cancer Res., Jun. 1980, 40: 2061-2068.

Kircher, M.F. et al., Noninvasive cell-tracking methods, Nat. Rev. Clin. Oncol., 2011, 8:677-688.

Kraitchman, D.L. et al., Imaging of stem cells using MRI, Basic Res. Cardiol., 2008, 103: 105-113.

Kraitchman, D.L. et al., Stem cell therapy: MRI guidance and monitoring, 2008, J. Magn. Reson. Imaging 27: 299-310.

Lane, C.E. et al., The eukaryotic tree of life: endosymbiosis takes its TOL, Trends Ecol. Evol., 2008, 23(5): 268-275.

Lang, C. et al., Expression of green fluorescent protein fused to magnetosome proteins in microaerophilic magnetotactic bacteria, Appl. Environ. Microbial., 2008, 74: 4944-53.

Lee, Z. et al., Imaging stem cell implant for cellular-based therapies, Exp. Biol. Med., 2008, 233: 930-940.

Lemmon, M.J. et al., Anaerobic bacteria as a gene delivery system that is controlled by the tumor microenvironment, Gene Ther., 1997, 4: 791-796.

Li, L.H. et al., Electrofusion between heterogeneous-sized mammalian cells in a pellet: potential applications in drug delivery . . . , Biophysical J., Jul. 1996, 71: 479-486.

Liu, S. et al., Anticancer efficacy of systemically delivered anaerobic bacteria as gene therapy vectors targeting tumor hypoxia/necrosis, Gene Ther., 2002, 9: 291-296.

Loessner, H. et al., Remote control of tumour-targeted *Salmonella entrerica* serovar Typhimurium by the use of L-arabinose . . . , Cell. Microbiol., 2007, 9(6): 1529-1537.

Login, F.H. et al., Antimicrobial peptides keep insect endosymbionts under control, Science, Oct. 21, 2011, 334: 362-365.

Long, C.M. et al., In vivo tracking of cellular therapeutics using magnetic resonance imaging, Expert Opin. Biol. Ther., 2009, 9(3): 293-306.

Long, M.E. et al., Disruption of *Francisella tularensis* schu S4 igll, iglJ, and pdpC genes results in attenuation . . . , Infect. Immun., Mar. 2013, 81(3): 850-861.

Martel, S. et al., Towards MRI-controlled ferromagnetic and MC-1 magnetotactic bacterial carriers . . . , Proceed. 28th IEEE EMBS Ann. Intl Conf. NY, 2006, pp. 3399-3402.

Matsunaga, T. et al., Phagocytosis of bacterial magnetite by leucocytes, Appl. Microbiol. Biotechnol., 1989, 31:401-405.

Matsunaga, T. et al., Gene transfer in magnetic bacteria: transposon mutagenesis and cloning of genomic DNA fragments . . . , J. Bacterial., May 1992, pp. 2748-2753.

Matsunaga, T. et al., Complete genome sequence of the facultative anaerobic magnetotactic bacterium *Magnetospirillum* sp. strain AMB-1, DNA Res., 2005, 12: 157-166.

Matsunaga, T. et al., Molecular bioengineering of bacterial magnetic particles . . . , Magnetoreception and Magnetosomes in Bacteria, 2006, pp. 227-54, Springer-Verlag, Berlin.

Min, J. et al., Quantitative bioluminescence imaging of tumor-targeting bacteria in living animals, Nat. Protocols, 2008, 3(4): 629-636.

Nishida, K. et al., Induction of biogenic magnetization and redox control by a component of the target of rapamycin complex 1 signaling pathway, PLoS Biol., 2012, 10:e1001269.

Okamoto, N. et al., A secondary symbiosis in progress?, Science, Oct. 14, 2005, 310: 287.

Oldroyd. G.E.D. et al., Reprogramming plant cells for endosymbiosis, Science, May 8, 2009, 324: 753-754.

O'Riordan, M. et al, Innate recognition of bacteria by a macrophage cytosolic surveillance pathway, Proc. Natl Acad. Sci., Oct. 15, 2002, 99(21): 13861-13866.

Pan, X. et al., Cationic lipid-coated magnetic nanoparticles associated with transferrin for gene delivery, Int. J. Pharm., Jun. 24, 2008, 358: 263-70.

Pawelek, J.M. et al., Tumor-targeted *Salmonella* as a novel anti-cancer vector, Cancer Res., Oct. 15, 1997, 57: 4537-4544.

Price, C.T.D. et al., Amoeba host-*Legionella* synchronization of amino acid auxotrophy and its role in bacterial adaptation . . . , Environ. Microbiol., 2013, 16(2): 350-358.

Qiu, B. et al., Dual transfer of GFP gene and MGd into stem-progenitor cells, Acad. Radiol., 2010, 17: 547-552.

Riegler, J. et al., Superparamagnetic iron oxide nanoparticle targeting of MSCs in vascular injury, Biomaterials, 2013, 34: 1987-1994.

Rogers, W.J. et al., Technology insight: in vivo cell tracking by use of MRI, Nature Clin. Prac., Oct. 2006, 3(10): 554-562.

Roodbeen R. et al., Synthetic cells and organelles: compartmentalization strategies, BioEssays, 2009, 31: 1299-1308.

Salminen, M. et al., Improvement in nuclear entry and transgene expression of baculoviruses by disintegration of microtubules . . . , J. Virol., Mar. 2005, 79(5): 2720-2728.

Schaffer, D. et al., Biological imaging in animals with genetically encoded magnetic reporter, Jan. 30, 2013, at http://www.berkeley.edu/news2/2013/01/KeckAbstract.htm.

Scheffel, A. et al., The acidic repetitive domain of the *Magnetospirillum gryphiswaldense* MamJ protein . . . , J. Bacteriol., Sep. 2007, 189(17): 6437-6446.

Schoen, P. et al., Gene transfer mediated by fusion protein hemagglutinin reconstituted in cationic lipid vesicles, Gene Ther., 1999, 6:823-832.

(56) References Cited

OTHER PUBLICATIONS

Schuler, D. et al., Dynamics of iron uptake and FeO4 biomineralization during aerobic and microaerobic growth . . . , J. Bacteriol., 1998, 180(1): 159-162.
Schuler, D. et al., Bacterial magnetosomes: microbiology, biomineralization, and biotechnological applications, Appl. Microbiol. Biotechnol., 1999, 52: 464-473.
Schultheiss, D. et al., Inactivation of the flagellin gene flaA in Magnetospirillum gryphiswaldense . . . , Appl. Environ. Microbiol., Jun. 2004, 70(6): 3624-2631.
Shoemaker, R.H., The NCI60 human tumour cell line anticancer drug screen, Nature Rev., Oct. 2006, 6: 813-823.
Silva, A.C. et al., Application of hyperthermia induced by superparamagnetic iron oxide nanoparticles in glioma treatment, Intl J. Nanomed., 2011, 6:591-603.
Smith, G.A. et al., The two distinct phospholipases C of Listeria monocytogenes have overlapping roles . . . , Infect. Immun., Nov. 1995, 63(11): 4231-4237.
Soghomonyan, S.A. et al., Positronic emissions tomography (PET) imaging of tumor-localized *Salmonella* expressing HSV1-TK, Cancer Gene Ther., 2005, 12: 101-108.
Stewart, F.J. et al., Lateral symbionts acquisition in a maternally transmitted chemosynthetic clam endosymbiosis, Mol. Biol. Evol., 2008, 25(4): 673-687.
Sugimoto, Y. et al., Differential cell division history between neutrophils and macrophages, British J. of Haematology, 2006, 135: 725-731.
Swiston, A.J. et al., Surface functionalization of living cells with multilayer patches, Nano Lett., 2008, 8(12): 4446-4453.
Sznol, M. et al., Use of preferentially replicating bacteria for the treatment of cancer, J. Clin. Invest., Apr. 2000, 105(8): 1027-1030.
Thao, M.L. et al., Phylogenetic analysis of vertically transmitted psyllid endosymbionts (Candidatus Carsonella ruddi) . . . , Curr. Microbiol., 2001, 42: 419-421.
Vaishnava, S. et al., The cell biology of secondary endosymbiosis—how parasites build, divide and segregate the apicoplast, Mol. Microbiol., 2006, 61(6): 1380-1387.
Valdivia R.H. et al., Endosymbiosis: the evil within, Current Biology, 2007, 17 (11): R408-R410.
Van Der Glezen, M., Endosymbiosis: past and present, Heredity, 2005, 95: 335-336.
Van Furth, R. et al., Dual origin of mouse spleen macrophages, J. Exp. Med., Nov. 1984, 160: 1273-1283.
Verhoeven, H.A. et al., Direct cell to cell transfer of organelles by microinjection, Plant Cell Reports, 1992, 10: 613-616.
Wajnberg, E. et al., Electron paramagnetic resonance study of the migratory ant Pachycondyla marginata abdomens, Biophys. J., Feb. 2000, 78: 1018-1023.
Wenergreen, J.J., Endosymbiosis: lessons in conflict resolution, PLoS Biology, Mar. 2004, 2(3): 307-311.
Widermann, A. et al., Yersinia enterocolitica invasin triggers phagocytosis via B1 integrins, CDC42Hs and WASp in macrophages, Cellular Microbiol., 2001, 3(10): 693-702.
Williams, K. et al., Proliferating cellular nuclear antigen expression as a marker of perivascular macrophages . . . , Am. J. Pathol., Aug. 2002, 161(2): 575-585.

Wyss Institute, New "magnetic yeast" could be significant step in harnessing nature's magnetic capabilities, Feb. 28, 2012, at http://wyss.harvard.edu/viewpressrelease/78.
Xi, Z. et al., Characterization of Wolbachia transfection efficiency by using microinjection of embryonic cytoplasm . . . , Appl. Environ. Microbiol., 2005, 71(6): 3199-3204.
Xie, J. et al., Production, modification, and bio-applications of magnetic nanoparticles gestated by Magnetotactic Bacteria, Nano Res., 2009, 2: 261-278.
Yam, C. et al., Monotherapy with a tumor-targeting mutant of S. typhimurium inhibits liver metastasis in a mouse model . . . , J. Surgical Res., 2010, 164: 248-255.
Yoshida, S. et al., Shigella deliver an effector protein to trigger host microtubule destabilization . . . , EMBO J., 2002, 21(12): 2923-2936.
Zhang, X. et al., Artificial innate immune system . . . , Proc. of the 3rd Int'l Conf. on Artificial Immun. Sys. (ICARIS), LNCS 3239, 2004, pp. 302-315.
Zhao, M. et al., Targeted therapy with a *Salmonella typhimurium* leucine-arginine auxotroph . . . , Cancer Res., Aug. 1, 2006, 66(15): 7647-7652.
Zhao, M., et al., Monotherapy with a tumor-targeting mutant of Salmonella typhimurium . . . , Proc. Natl. Acad. Sci., Jun. 12, 2007, 104(24): 10170-10174.
Wixon, Featured Organism: Reductive evolution in nacteria *Buchnera* sp. Rickettsia Prowazekii and . . . 2001, vol. 2, pp. 44-48.
Klasson et al., Horizontal gene transfer between Wolbachia and mosquito *Aedes aegypti*, BMC Genomics, 2009, 10:33-42.
Iovieno et al., Detection of bacterial endosymbionts in clinical acanthamoeba isolates, 2010, Ophthamology 117:445-452.
Ordway et al., Animal models of mycobacteria infection, 2011, Current Protocols in Immunology Ch. 19, p. 19.5.1.
Murat, D. et al., The magnetosome membrane protein, MmsF is a major regulator of magnetite biomineralization in Magnetospirillum . . . AMB-1, Molc. Microb. 2012, 85:684-699.
Lang, C et al., Expression of green fluorescent protein fused to magnetosome proteins in microaerophilic magentotactic bacteria, Appl. Environ. Microb. 2008, 74:4944-4953.
Kovach, M.E., et al., Four new derivatives of the broad-host-range cloning vector pBBR1MCS, carrying different antibiotic-resistance cassettes, Gene 1995, 166:175-176.
Bian et al., The endosymbiotic bacterium Wolbachia induces resistance to dengue virus in *Aedes aegypti*, PLos Pathogen vol. 6, p. e1000833 (2010).
Calvitti, Bacteria endosymbionts: a source of innovation in biotechnology for the control of vector borne diseases, Energia Amb. Innovaz. n. 6, Nov-Div 2011, pp. 49-57.
Yan et al, Magnetotactic bacteria, magnetosomes and their application, Microbiol. Res. (May 9, 2012) vol. 167, pp. 507-519.
Chen et al., Microwave breast tumor detection and size estimation using contrast agent loaded magnetotactic bacteria, 35th Ann. Intl Conf IEEE EMBS, pp. 5781-5484 (2013).
Ramos et al., Temporal and spatial control of transgene expression using laser induction of the hsp70 promoter, BMC Develop. Biol. vol. 6, pp. 1-7 (2006).
Vilaboa et al., Gene switches for deliberate regulation of transgene expression: recent advances . . . , Genet. Synd. Gene Therap. vol. 2, pp. 1-23 (2011).

| Description | Max score | Total score | Query cover | E value | Ident | Accession No. |
|---|---|---|---|---|---|---|
| Type V secretory pathway, adhesin AidA [Magnetospirillum magneticum AMB-1] | 7176 | 7176 | 100% | 0.0 | 100% | YP_421364.1 |
| large exoprotein [Magnetospirillum magneticum AMB-1] | 2959 | 13522 | 46% | 0.0 | 97% | YP_420631.1 |
| Type V secretory pathway [Magnetospirillum magneticum AMB-1] | 2061 | 6654 | 30% | 0.0 | 96% | YP_420638.1 |
| COG2931: RTX toxins and related Ca2+-binding proteins [Magnetospirillum magnetotacticum] | 1976 | 2249 | 51% | 0.0 | 86% | WP_009868207.1 |
| COG5295: Autotransporter adhesin [Magnetospirillum magnetotacticum] | 1672 | 3488 | 63% | 0.0 | 74% | WP_009869454.1 |
| RTX toxins and related Ca2+-binding protein [Magnetospirillum magneticum AMB-1] | 1385 | 2589 | 46% | 0.0 | 90% | YP_420640.1 |
| Type V secretory pathway, adhesin AidA, partial [Magnetospirillum sp. SO-1] | 917 | 2302 | 59% | 0.0 | 76% | WP_008619475.1 |
| cell surface glycoprotein precursor [Magnetospirillum magneticum AMB-1] | 646 | 3709 | 36% | 0.0 | 84% | YP_421357.1 |
| cell surface glycoprotein precursor [Magnetospirillum magneticum AMB-1] | 643 | 3861 | 50% | 0.0 | 84% | YP_421356.1 |
| hypothetical protein, partial [Magnetospirillum magnetotacticum] | 626 | 1291 | 39% | 0.0 | 86% | WP_009868028.1 |
| flagellin-like protein [Magnetospirillum magneticum AMB-1] | 624 | 3408 | 43% | 0.0 | 82% | YP_421362.1 |
| COG2931: RTX toxins and related Ca2+-binding proteins [Magnetospirillum magnetotacticum] | 574 | 1725 | 51% | 1e-164 | 42% | WP_009868027.1 |
| Autotransporter adhesin [Magnetospirillum gryphiswaldense MSR-1] | 579 | 1060 | 63% | 9e-163 | 42% | CAM76579.1 |
| hypothetical protein, partial [Magnetospirillum magnetotacticum] | 534 | 2506 | 43% | 3e-162 | 56% | WP_009868025.1 |
| hypothetical protein RPB_1638 [Rhodopseudomonas palustris HaA2] | 562 | 3550 | 52% | 2e-157 | 44% | YP_485257.1 |
| hypothetical protein, partial [Vibrio tasmaniensis] | 507 | 3274 | 45% | 1e-143 | 40% | WP_017102899.1 |
| Type V secretory pathway, partial [Vibrionales bacterium SWAT-3] | 446 | 2207 | 48% | 1e-132 | 48% | WP_008223511.1 |
| outer membrane adhesin-like protein [Shewanella loihica PV-4] | 471 | 3208 | 52% | 3e-130 | 37% | YP_001092641.1 |
| hypothetical protein [Achromobacter xylosoxidans] | 436 | 2670 | 57% | 1e-128 | 43% | WP_006387942.1 |
| hypothetical protein VS_II0512 [Vibrio splendidus LGP32] | 454 | 1648 | 35% | 5e-125 | 38% | YP_002395108.1 |
| hypothetical protein, partial [Vibrio breoganii] | 431 | 2494 | 40% | 2e-124 | 43% | WP_017031543.1 |
| hypothetical protein [Vibrio tasmaniensis] | 452 | 3192 | 49% | 5e-124 | 44% | WP_017109466.1 |
| Large exoprotein [Vibrio furnissii NCTC 11218] | 448 | 1554 | 37% | 7e-123 | 45% | YP_005048901.1 |
| COG5651: PPE-repeat proteins [Magnetospirillum magnetotacticum] | 402 | 1212 | 43% | 1e-119 | 60% | WP_009866462.1 |
| hypothetical protein, partial [Variovorax paradoxus] | 413 | 1983 | 44% | 3e-118 | 37% | WP_018907567.1 |
| hypothetical protein, partial [Vibrio breoganii] | 417 | 2000 | 49% | 4e-118 | 39% | WP_017029526.1 |
| VCBS repeat-containing protein [Bradyrhizobium sp. WSM471] | 424 | 2024 | 29% | 6e-117 | 44% | WP_007606711.1 |
| VCBS repeat-containing protein [Desulfomonile tiedjei DSM 6799] | 428 | 2103 | 41% | 1e-116 | 41% | YP_006446912.1 |
| outer membrane adhesin like protein, partial [Pseudogulbenkiania ferrooxidans] | 402 | 1967 | 41% | 4e-116 | 46% | WP_008955916.1 |

*FIG. 1A*

| Description | Max score | Total score | Query cover | E value | Ident | Accession No. |
|---|---|---|---|---|---|---|
| hypothetical protein, partial [Vibrio splendidus] | 419 | 2628 | 53% | 2e-115 | 37% | WP_017081492.1 |
| hypothetical protein amb1998 [Magnetospirillum magneticum AMB-1] | 377 | 2838 | 28% | 2e-114 | 97% | YP_421361.1 |
| Type V secretory pathway, partial [Vibrionales bacterium SWAT-3] | 401 | 1423 | 45% | 4e-114 | 44% | WP_008224673.1 |
| outer membrane adhesin-like protein [Calothrix sp. PCC 7507] | 417 | 1307 | 48% | 6e-114 | 41% | YP_007065062.1 |
| TISS secreted agglutinin (RTX [Achromobacter xylosoxidans NH44784-1996] | 415 | 920 | 51% | 2e-113 | 39% | YP_008030908.1 |
| hypothetical protein, partial [Vibrio tasmaniensis] | 394 | 2338 | 49% | 1e-111 | 39% | WP_017101375.1 |
| outer membrane adhesin-like protein [Sulfurimonas gotlandica] | 404 | 1294 | 47% | 6e-111 | 34% | WP_008341635.1 |
| hypothetical protein, partial [Sulfurimonas gotlandica] | 404 | 1325 | 47% | 6e-111 | 34% | WP_008340241.1 |
| outer membrane adhesin like protein [Variovorax paradoxus S110] | 404 | 2165 | 41% | 6e-110 | 38% | YP_002947797.1 |
| VCBS repeat protein [Shewanella piezotolerans WP3] | 396 | 3809 | 64% | 7e-107 | 34% | YP_002313811.1 |
| VCBS [Dechloromonas aromatica RCB] | 389 | 1017 | 31% | 9e-105 | 41% | YP_286399.1 |
| hypothetical protein Reut_C5971 [Ralstonia eutropha JMP134] | 383 | 1173 | 56% | 5e-104 | 36% | YP_293166.1 |
| hypothetical protein [Vibrio splendidus] | 383 | 1638 | 44% | 4e-103 | 34% | WP_017082048.1 |
| VCBS repeat protein [Vibrio splendidus] | 382 | 2732 | 44% | 1e-102 | 34% | WP_004731498.1 |
| VCBS [Chlorobium ferrooxidans] | 380 | 2923 | 52% | 2e-102 | 41% | WP_006366861.1 |
| hypothetical protein, partial [Achromobacter piechaudii] | 379 | 915 | 39% | 8e-102 | 42% | WP_006218690.1 |
| iron-regulated protein FrpC [Vibrio tubiashii] | 378 | 1833 | 58% | 1e-101 | 40% | WP_004747418.1 |
| toxin [Vibrio sp. MED222] | 374 | 2355 | 41% | 2e-100 | 39% | WP_009845528.1 |
| type 1 secretion target domain-containing protein, partial [Rhizobium sp. PDO1-076] | 370 | 1692 | 42% | 2e-100 | 40% | WP_007606142.1 |
| hypothetical protein, partial [Vibrio tasmaniensis] | 367 | 2741 | 46% | 5e-99 | 38% | WP_017099027.1 |
| hemolysin-type calcium-binding repeat family protein 3, partial [Achromobacter piechaudii] | 362 | 1125 | 59% | 3e-98 | 37% | WP_006223938.1 |
| hypothetical protein [Vibrio owensii] | 365 | 2665 | 61% | 1e-97 | 35% | WP_020195639.1 |
| outer membrane adhesin-like protein [Methylobacterium sp. 4-46] | 364 | 1017 | 52% | 2e-97 | 36% | YP_001770167.1 |
| VCBS repeat-containing protein [Variovorax sp. CF313] | 352 | 1606 | 65% | 5e-96 | 34% | WP_007828145.1 |
| hypothetical protein, partial [Vibrio splendidus] | 343 | 1802 | 49% | 2e-95 | 38% | WP_019350838.1 |
| Large exoprotein, partial [Achromobacter piechaudii] | 345 | 1517 | 47% | 5e-95 | 40% | WP_006228189.1 |
| hypothetical protein, partial [Vibrio splendidus] | 353 | 1655 | 49% | 2e-94 | 34% | WP_017086433.1 |
| outer membrane adhesin-like protein [Shewanella baltica BA175] | 348 | 950 | 42% | 3e-94 | 39% | YP_006019007.1 |
| RTX toxin hemolysin-type protein [Rhizobium etli CFN 42] | 347 | 1347 | 32% | 6e-94 | 36% | YP_470132.1 |
| outer membrane adhesin-like protein [Desulfovibrio aespoeensis Aspo-2] | 352 | 1396 | 62% | 1e-93 | 35% | YP_004120666.1 |
| hypothetical protein, partial [Vibrio splendidus] | 335 | 2564 | 51% | 2e-93 | 37% | WP_019350792.1 |

*FIG. 1B*

| Description | Max score | Total score | Query cover | E value | Ident | Accession No. |
|---|---|---|---|---|---|---|
| hypothetical protein [Vibrio splendidus] | 337 | 1674 | 46% | 2e-93 | 37% | WP_020477147.1 |
| RTX toxin exported protein [Ralstonia eutropha H16] | 342 | 1549 | 65% | 4e-92 | 34% | YP_728854.1 |
| hypothetical protein, partial [Vibrio breoganii] | 342 | 4678 | 65% | 2e-90 | 32% | WP_017243041.1 |
| hypothetical protein AZKH_2157 [Azoarcus sp. KH32C] | 341 | 965 | 57% | 2e-90 | 33% | YP_007551444.1 |
| hypothetical protein PCA10_42970 [Pseudomonas resinovorans NBRC 106553] | 341 | 2061 | 66% | 2e-90 | 37% | YP_008104634.1 |
| metalloprotease, hemolysin-type calcium-binding region [Cupriavidus taiwanensis LMG 19424] | 336 | 1092 | 60% | 6e-90 | 32% | YP_002008092.1 |
| RTX toxin hemolysin-type protein [Sinorhizobium fredii NGR234] | 333 | 1043 | 53% | 9e-90 | 35% | YP_002827036.1 |
| RTX toxin [Rhizobium leguminosarum] | 333 | 928 | 37% | 9e-90 | 36% | WP_003580127.1 |
| structural toxin [Chromobacterium violaceum ATCC 12472] | 338 | 1657 | 62% | 3e-89 | 36% | NP_899981.1 |
| hypothetical protein [Vibrio tubiashii] | 335 | 3285 | 63% | 2e-88 | 33% | WP_004744158.1 |
| hypothetical protein [Vibrio natriegens] | 333 | 2701 | 56% | 5e-88 | 33% | WP_020334262.1 |
| hypothetical protein [Vibrionales bacterium SWAT-3] | 329 | 2870 | 69% | 1e-86 | 38% | WP_008216195.1 |
| hypothetical protein, partial [Vibrio genomosp. F6] | 325 | 2872 | 57% | 2e-86 | 34% | WP_017054796.1 |
| secreted VCBS domain protein [Shewanella oneidensis MR-1] | 328 | 3931 | 63% | 2e-86 | 33% | NP_719678.1 |
| VCBS protein [Bilophila wadsworthia] | 327 | 2906 | 59% | 5e-86 | 34% | WP_016361080.1 |
| VCBS protein [Chlorobium ferrooxidans] | 323 | 1303 | 44% | 1e-85 | 38% | WP_006366860.1 |
| Large exoprotein, partial [Achromobacter piechaudii] | 307 | 1303 | 32% | 2e-85 | 43% | WP_006228258.1 |
| Large exoprotein, partial [Achromobacter piechaudii] | 316 | 1488 | 40% | 3e-85 | 39% | WP_006228197.1 |
| COG2931: RTX toxins and related Ca2+-binding proteins [Magnetospirillum magnetotacticum] | 312 | 1792 | 56% | 7e-85 | 46% | WP_009867477.1 |
| hypothetical protein bll3714 [Bradyrhizobium diazoefficiens USDA 110] | 320 | 719 | 24% | 4e-84 | 36% | NP_770354.1 |
| toxin, partial [Vibrio splendidus] | 313 | 1732 | 52% | 4e-82 | 36% | WP_017092000.1 |
| RTX toxin exported protein RtxA [Cupriavidus necator N-1] | 308 | 1530 | 48% | 1e-80 | 37% | YP_004680854.1 |
| hypothetical protein, partial [Enterovibrio calviensis] | 304 | 1484 | 46% | 1e-79 | 34% | WP_017017027.1 |
| hypothetical protein [Desulfovibrio sp. 6_1_46AFAA] | 303 | 1839 | 42% | 2e-79 | 32% | WP_009301782.1 |
| hypothetical protein AHA_3491 [Aeromonas hydrophila subsp. hydrophila ATCC 7966] | 303 | 1839 | 48% | 6e-79 | 41% | YP_857965.1 |
| hypothetical protein [Desulfovibrio sp. 6_1_46AFAA] | 298 | 1945 | 57% | 8e-79 | 35% | WP_009301784.1 |
| outer membrane adhesin like protein [Pseudogulbenkiania sp. NH8B] | 296 | 1265 | 43% | 2e-78 | 39% | YP_004848254.1 |
| hypothetical protein, partial [Enterovibrio calviensis] | 300 | 1760 | 48% | 3e-78 | 33% | WP_017015203.1 |
| iron-regulated protein FrpC [Vibrio rotiferianus] | 300 | 3682 | 65% | 8e-78 | 34% | WP_010452358.1 |

FIG. 1C

| Description | Max score | Total score | Query cover | E value | Ident | Accession No. |
|---|---|---|---|---|---|---|
| large exoprotein [Desulfovibrio sp. 3_1_syn3] | 299 | 2320 | 58% | 1e-77 | 33% | WP_008684592.1 |
| outer membrane adhesin like protein [Pseudomonas mendocina NK-01] | 297 | 1806 | 73% | 5e-77 | 33% | YP_004379207.1 |
| iron-regulated protein FrpC, partial [Vibrio nigripulchritudo] | 296 | 2090 | 43% | 6e-77 | 33% | WP_004400669.1 |
| iron-regulated protein FrpC [Vibrio fischeri MJ11] | 296 | 2422 | 55% | 8e-77 | 34% | YP_002156318.1 |
| hypothetical protein, partial [Enterovibrio norvegicus] | 290 | 1683 | 46% | 2e-76 | 32% | WP_016959134.1 |
| hypothetical protein [Pseudomonas mendocina] | 293 | 1804 | 64% | 1e-75 | 34% | WP_017361689.1 |
| VCBS repeat protein [Vibrio shilonii] | 292 | 3039 | 70% | 1e-75 | 33% | WP_006072371.1 |
| hypothetical protein, partial [Desulfovibrio sp. 6_1_46AFAA] | 290 | 1887 | 56% | 3e-75 | 33% | WP_009301783.1 |
| hypothetical protein, partial [Pseudomonas umsongensis] | 286 | 1822 | 48% | 6e-74 | 32% | WP_018926333.1 |
| RTX repeat-containing calcium-binding cytotoxin RtxA1 [Vibrio fischeri ES114] | 285 | 2505 | 57% | 3e-73 | 34% | YP_204889.1 |
| hypothetical protein, partial [Enterovibrio norvegicus] | 281 | 1262 | 36% | 1e-72 | 32% | WP_017003860.1 |

*FIG. 1D*

| Description | Max score | Total score | Query cover | E value | Ident | Accession No. |
|---|---|---|---|---|---|---|
| RTX toxins and related Ca2+-binding protein [Magnetospirillum magneticum AMB-1] | 3583 | 3583 | 100% | 0.0 | 100% | YP_420640.1 |
| COG5295: Autotransporter adhesin [Magnetospirillum magnetotacticum] | 2085 | 3813 | 99% | 0.0 | 78% | WP_009869454.1 |
| Type V secretory pathway, adhesin AidA [Magnetospirillum magneticum AMB-1] | 1390 | 2215 | 55% | 0.0 | 90% | YP_421364.1 |
| Type V secretory pathway, adhesin AidA, partial [Magnetospirillum sp. SO-1] | 598 | 846 | 49% | 7e-180 | 59% | WP_008619475.1 |
| hypothetical protein, partial [Magnetospirillum magnetotacticum] | 559 | 746 | 27% | 3e-179 | 79% | WP_009868028.1 |
| COG2931: RTX toxins and related Ca2+-binding proteins [Magnetospirillum magnetotacticum] | 539 | 1231 | 50% | 2e-156 | 84% | WP_009868027.1 |
| Autotransporter adhesin [Magnetospirillum gryphiswaldense MSR-1] | 331 | 920 | 64% | 3e-88 | 37% | CAM76579.1 |
| large exoprotein [Magnetospirillum magneticum AMB-1] | 291 | 2139 | 27% | 5e-76 | 66% | YP_420631.1 |
| Type V secretory pathway [Magnetospirillum magneticum AMB-1] | 291 | 1517 | 27% | 5e-76 | 66% | YP_420638.1 |
| flagellin-like protein [Magnetospirillum magneticum AMB-1] | 244 | 689 | 24% | 4e-67 | 71% | YP_421362.1 |
| putative Ca binding RTX toxin [Azospirillum lipoferum 4B] | 224 | 935 | 96% | 1e-55 | 31% | YP_005040816.1 |
| COG5651: PPE-repeat proteins [Magnetospirillum magnetotacticum] | 195 | 676 | 36% | 3e-49 | 47% | WP_009866462.1 |
| hemolysin-type calcium-binding region [Azospirillum sp. B510] | 191 | 829 | 85% | 2e-45 | 30% | YP_003452293.1 |
| VCBS repeat protein [Vibrio shilonii] | 189 | 1538 | 68% | 7e-45 | 28% | WP_006072371.1 |
| VBCS repeat-containing protein [Colwellia psychrerythraea 34H] | 177 | 1110 | 52% | 4e-41 | 43% | YP_269146.1 |
| polymer-forming cytoskeletal family protein [Vibrio harveyi] | 172 | 1381 | 76% | 8e-40 | 31% | WP_017819225.1 |
| hypothetical protein, partial [Enterovibrio calviensis] | 169 | 214 | 44% | 3e-39 | 27% | WP_017013208.1 |
| hypothetical protein, partial [Vibrio alginolyticus] | 170 | 384 | 50% | 4e-39 | 31% | WP_017821990.1 |
| hypothetical protein, partial [Vibrio breoganii] | 165 | 581 | 48% | 2e-37 | 42% | WP_017242742.1 |
| hypothetical protein, partial [Vibrio breoganii] | 164 | 700 | 36% | 2e-37 | 42% | WP_017029493.1 |
| hypothetical protein, partial [Vibrio breoganii] | 165 | 715 | 31% | 2e-37 | 42% | WP_017031546.1 |
| hypothetical protein, partial [Vibrio splendidus] | 164 | 518 | 33% | 3e-37 | 42% | WP_017081491.1 |
| hypothetical protein, partial [Vibrio splendidus] | 164 | 836 | 58% | 3e-37 | 42% | WP_017077555.1 |
| outer membrane adhesin-like protein, partial [Acetivibrio cellulolyticus] | 163 | 455 | 55% | 5e-37 | 32% | WP_010245949.1 |
| outer membrane adhesin like protein [Methylobacterium extorquens] | 161 | 878 | 69% | 2e-36 | 30% | WP_003596515.1 |
| polymer-forming cytoskeletal family protein [Vibrio harveyi] | 161 | 1451 | 74% | 3e-36 | 27% | WP_005442621.1 |
| hypothetical protein, partial [Vibrio splendidus] | 160 | 438 | 13% | 3e-36 | 40% | WP_017081492.1 |
| polymer-forming cytoskeletal family protein [Vibrio sp. HENC-03] | 160 | 1270 | 76% | 4e-36 | 28% | WP_009704723.1 |
| hypothetical protein [Vibrio owensii] | 160 | 1253 | 59% | 4e-36 | 40% | WP_020195639.1 |
| polymer-forming cytoskeletal family protein [Vibrio alginolyticus] | 160 | 1428 | 78% | 4e-36 | 27% | WP_005375591.1 |

*FIG. 2A*

| Description | Max score | Total score | Query cover | E value | Ident | Accession No. |
|---|---|---|---|---|---|---|
| hypothetical protein Metbo_1350 [Methanobacterium sp. AL-21] | 158 | 415 | 29% | 1e-35 | 38% | YP_004290562.1 |
| hemolysin-type calcium-binding region, partial [Thalassospira xiamenensis] | 157 | 464 | 81% | 4e-35 | 27% | WP_007092538.1 |
| hypothetical protein PCA10_42970 [Pseudomonas resinovorans NBRC 106553] | 157 | 797 | 54% | 5e-35 | 30% | YP_008104634.1 |
| RTX toxins-related Ca2+-binding protein [Methylophaga sp. JAM7] | 156 | 156 | 18% | 8e-35 | 36% | YP_006294136.1 |
| VCBS repeat-containing protein [Solitalea canadensis DSM 3403] | 155 | 534 | 50% | 1e-34 | 32% | YP_006254384.1 |
| putative hemolysin [Cellvibrio japonicus Ueda107] | 154 | 521 | 28% | 3e-34 | 38% | YP_001981885.1 |
| polymer-forming cytoskeletal family protein, partial [Vibrio splendidus] | 154 | 1410 | 73% | 5e-34 | 27% | WP_017079130.1 |
| type I secretion target GGXGXDXXX repeat protein domain protein [Methylophaga thiooxydans] | 152 | 152 | 16% | 1e-33 | 38% | WP_008291998.1 |
| outer membrane adhesin-like protein [Mycobacterium phlei] | 150 | 368 | 53% | 5e-33 | 32% | WP_003886432.1 |
| polymer-forming cytoskeletal family protein [Vibrio harveyi] | 150 | 1418 | 74% | 6e-33 | 27% | WP_017188870.1 |
| hypothetical protein, partial [Vibrio splendidus] | 148 | 858 | 28% | 2e-32 | 38% | WP_017086433.1 |
| putative outer membrane adhesin-like protein [Psychrobacter sp. PRwf-1] | 145 | 536 | 35% | 2e-31 | 38% | YP_001280066.1 |
| hypothetical protein VS_II0856 [Vibrio splendidus LGP32] | 145 | 1505 | 76% | 2e-31 | 27% | YP_002395438.1 |
| hypothetical protein [gamma proteobacterium NOR5-3] | 144 | 858 | 48% | 5e-31 | 31% | WP_009023297.1 |
| polymer-forming cytoskeletal family protein [Vibrio splendidus] | 143 | 1418 | 75% | 8e-31 | 27% | WP_017082341.1 |
| polymer-forming cytoskeletal family protein, partial [Vibrio splendidus] | 142 | 1555 | 63% | 1e-30 | 27% | WP_017092649.1 |
| polymer-forming cytoskeletal family protein [Vibrio splendidus] | 142 | 1128 | 70% | 2e-30 | 27% | WP_019350981.1 |
| polymer-forming cytoskeletal family protein [Vibrio splendidus] | 142 | 1131 | 70% | 2e-30 | 27% | WP_004730529.1 |
| outer membrane adhesin-like protein [Chitinophaga pinensis DSM 2588] | 142 | 436 | 24% | 2e-30 | 40% | YP_003125000.1 |
| hypothetical protein, partial [Enterovibrio norvegicus] | 140 | 323 | 45% | 3e-30 | 27% | WP_017003861.1 |
| hypothetical protein [Paenibacillus sp. HGH0039] | 140 | 311 | 29% | 4e-30 | 37% | WP_009672533.1 |
| hypothetical protein [Pseudomonas mendocina] | 140 | 620 | 51% | 7e-30 | 28% | WP_017361689.1 |
| hypothetical protein [Congregibacter litoralis] | 140 | 823 | 61% | 7e-30 | 30% | WP_008294433.1 |
| outer membrane adhesin like protein [Pseudomonas mendocina NK-01] | 139 | 543 | 51% | 9e-30 | 28% | YP_004379207.1 |
| polymer-forming cytoskeletal family protein, partial [Vibrio splendidus] | 134 | 1525 | 77% | 3e-28 | 27% | WP_017081150.1 |
| metalloprotease, hemolysin-type calcium-binding region [Cupriavidus taiwanensis LMG 19424] | 134 | 292 | 67% | 4e-28 | 27% | YP_002008092.1 |
| hypothetical protein, partial [Vibrio crassostreae] | 133 | 1232 | 77% | 7e-28 | 26% | WP_017068684.1 |
| polymer-forming cytoskeletal family protein, partial [Vibrio crassostreae] | 133 | 1556 | 63% | 8e-28 | 26% | WP_017072194.1 |
| polymer-forming cytoskeletal family protein, partial [Vibrio crassostreae] | 133 | 1468 | 64% | 8e-28 | 26% | WP_017064674.1 |
| VCBS [Chlorobium ferrooxidans] | 133 | 792 | 45% | 9e-28 | 28% | WP_006366861.1 |

*FIG. 2B*

| Description | Max score | Total score | Query cover | E value | Ident | Accession No. |
|---|---|---|---|---|---|---|
| polymer-forming cytoskeletal family protein, partial [Vibrio tasmaniensis] | 133 | 1497 | 77% | 9e-28 | 27% | WP_017100400.1 |
| hypothetical protein AM1_E0108 [Acaryochloris marina MBIC11017] | 131 | 436 | 35% | 3e-27 | 40% | YP_001522191.1 |
| outer membrane adhesin like protein [Cellvibrio sp. BR] | 130 | 408 | 66% | 5e-27 | 37% | WP_007642508.1 |
| outer membrane adhesin-like protein [Methylobacterium sp. 4-46] | 130 | 446 | 44% | 7e-27 | 28% | YP_001770167.1 |
| hypothetical protein AZKH_2157 [Azoarcus sp. KH32C] | 130 | 596 | 38% | 8e-27 | 42% | YP_007551444.1 |
| VCBS repeat protein [Vibrio splendidus] | 129 | 1088 | 21% | 1e-26 | 39% | WP_004731498.1 |
| hemagglutinin/hemolysin-like protein [Dickeya dadantii 3937] | 129 | 438 | 30% | 2e-26 | 41% | YP_003881756.1 |
| polymer-forming cytoskeletal family protein, partial [Vibrio splendidus] | 129 | 1389 | 72% | 2e-26 | 27% | WP_017094008.1 |
| Conserved repeat protein [Bacillus megaterium WSH-002] | 127 | 934 | 31% | 4e-26 | 37% | YP_005497395.1 |
| RTX toxin [Vibrio sp. EJY3] >ref|WP_014235121.1| RTX toxin [Vibrio sp. EJY3] | 127 | 835 | 28% | 5e-26 | 36% | YP_005025033.1 |
| outer membrane adhesin-like protein [Calothrix sp. PCC 7507] | 127 | 372 | 27% | 5e-26 | 42% | YP_007065062.1 |
| outer membrane adhesin-like protein [Desulfovibrio aespoeensis Aspo-2] | 126 | 757 | 51% | 8e-26 | 34% | YP_004120666.1 |
| FG-GAP repeat domain protein [Coleofasciculus chthonoplastes] | 125 | 224 | 44% | 2e-25 | 28% | WP_006103065.1 |
| hypothetical protein, partial [Desulfovibrio sp. 6_1_46AFAA] | 125 | 929 | 39% | 2e-25 | 36% | WP_009301783.1 |
| hypothetical protein, partial [Pseudomonas nitroreducens TX1] | 125 | 651 | 71% | 2e-25 | 37% | WP_017519457.1 |
| hypothetical protein [Vibrio natriegens] | 125 | 692 | 44% | 2e-25 | 32% | WP_020334262.1 |
| VCBS [Roseovarius sp. 217] | 125 | 501 | 41% | 2e-25 | 33% | WP_009817742.1 |
| outer membrane adhesin-like protein [Chitinophaga pinensis DSM 2588] | 124 | 282 | 32% | 3e-25 | 38% | YP_003124906.1 |
| putative RTX toxin [Photobacterium damselae] | 124 | 336 | 36% | 4e-25 | 33% | WP_005301102.1 |
| cadherin prodomain like family protein, partial [Vibrio sp. HENC-01] | 122 | 1053 | 76% | 2e-24 | 26% | WP_009696193.1 |
| outer membrane adhesin like protein [Variovorax paradoxus S110] | 121 | 798 | 68% | 4e-24 | 46% | YP_002947797.1 |
| hypothetical protein, partial [Vibrio splendidus] | 120 | 705 | 35% | 6e-24 | 36% | WP_017094769.1 |
| hypothetical protein, partial [Achromobacter piechaudii] | 119 | 755 | 19% | 1e-23 | 36% | WP_006218690.1 |
| VCBS [Pelagibaca bermudensis] | 118 | 605 | 60% | 3e-23 | 36% | WP_009622276.1 |
| hypothetical protein, partial [Variovorax paradoxus] | 117 | 390 | 29% | 3e-23 | 40% | WP_018907567.1 |
| hypothetical protein AHA_3491 [Aeromonas hydrophila subsp. hydrophila ATCC 7966] | 118 | 489 | 50% | 3e-23 | 28% | YP_857965.1 |
| secreted VCBS domain protein [Shewanella oneidensis MR-1] | 116 | 1089 | 38% | 1e-22 | 40% | NP_719678.1 |
| hypothetical protein, partial [Vibrio tasmaniensis] | 115 | 866 | 23% | 1e-22 | 37% | WP_017102899.1 |
| hemolysin-type calcium-binding repeat family protein 3, partial [Achromobacter piechaudii] | 115 | 785 | 45% | 1e-22 | 35% | WP_006223938.1 |
| structural toxin [Chromobacterium violaceum ATCC 12472] | 115 | 968 | 56% | 2e-22 | 26% | NP_899981.1 |

FIG. 2C

| Description | Max score | Total score | Query cover | E value | Ident | Accession No. |
|---|---|---|---|---|---|---|
| hemolysin [Achromobacter arsenitoxydans] | 115 | 317 | 35% | 2e-22 | 55% | WP_008164882.1 |
| hemolysin-type calcium-binding region, partial [Thalassospira profundimaris] | 114 | 244 | 61% | 6e-22 | 26% | WP_008891487.1 |
| hypothetical protein [Vibrio splendidus] | 112 | 1212 | 43% | 2e-21 | 39% | WP_017082048.1 |
| outer membrane adhesin-like protein [Variovorax paradoxus S110] | 111 | 406 | 37% | 4e-21 | 37% | YP_002946474.1 |
| outer membrane adhesin-like protein [Denitrovibrio acetiphilus DSM 12809] | 111 | 484 | 45% | 4e-21 | 38% | YP_003505219.1 |
| VCBS repeat-containing protein [Desulfomonile tiedjei DSM 6799] | 111 | 1132 | 36% | 4e-21 | 40% | YP_006446912.1 |

*FIG. 2D*

| Description | Max score | Total score | Query cover | E value | Ident | Accession No. |
|---|---|---|---|---|---|---|
| RTX toxins and related Ca2+-binding protein [Magnetospirillum magneticum AMB-1] | 2585 | 2585 | 100% | 0.0 | 100% | YP_423419.1 |
| COG2931: RTX toxins and related Ca2+-binding proteins [Magnetospirillum magnetotacticum] | 910 | 910 | 58% | 0.0 | 65% | WP_009869271.1 |
| RTX toxin [Magnetospirillum sp. SO-1] | 601 | 751 | 63% | 0.0 | 54% | WP_008615895.1 |
| COG4254: Uncharacterized protein conserved in bacteria [Magnetospirillum magnetotacticum] | 377 | 377 | 15% | 1e-116 | 91% | WP_009869323.1 |
| RTX toxins and related Ca2+-binding protein [Magnetospirillum magneticum AMB-1] | 331 | 569 | 51% | 6e-91 | 79% | YP_422662.1 |
| RTX toxins and related Ca2+-binding proteins [Magnetospirillum gryphiswaldense MSR-1] | 310 | 602 | 67% | 5e-86 | 50% | CAM75368.1 |
| proprotein convertase P [Beijerinckia indica subsp. indica ATCC 9039] | 163 | 381 | 61% | 3e-37 | 32% | YP_001830991.1 |
| calcium binding hemolysin protein [Thalassospira profundimaris] | 155 | 1219 | 67% | 1e-34 | 30% | WP_008888391.1 |
| hemolysin-type calcium-binding region [Schlesneria paludicola] | 143 | 224 | 56% | 3e-31 | 30% | WP_010587000.1 |
| hemolysin-type calcium-binding region [Roseibium sp. TrichSKD4] | 144 | 1160 | 65% | 3e-31 | 32% | WP_009467822.1 |
| HEMAGGLUTININ/HEMOLYSIN-RELATED PROTEIN [Magnetospirillum gryphiswaldense MSR-1] | 142 | 194 | 32% | 9e-31 | 36% | CAM76811.1 |
| hemolysin-type calcium-binding region [Nostoc punctiforme PCC 73102] | 135 | 135 | 50% | 5e-29 | 31% | YP_001867978.1 |
| putative rhizobiocin/RTX toxin and hemolysin-type calcium-binding protein [Methylovorus glucosetrophus SIP3-4] | 134 | 271 | 63% | 2e-28 | 31% | YP_003051754.1 |
| hemolysin-type calcium-binding protein [Pseudovibrio sp. FO-BEG1] | 130 | 371 | 58% | 2e-27 | 28% | YP_005082876.1 |
| hypothetical protein [Scytonema hofmanni] | 127 | 203 | 54% | 3e-26 | 29% | WP_017749095.1 |
| hemolysin-type calcium-binding region [Nostoc punctiforme PCC 73102] | 125 | 367 | 64% | 8e-26 | 29% | YP_001864081.1 |
| Hemolysin-type calcium-binding region [Rhodobacter sp. SW2] | 125 | 641 | 69% | 1e-25 | 30% | WP_008029683.1 |
| hypothetical protein [Scytonema hofmanni] | 124 | 368 | 65% | 1e-25 | 31% | WP_017744127.1 |
| hypothetical protein [Rhizobium leguminosarum] | 124 | 810 | 63% | 2e-25 | 31% | WP_017990332.1 |
| hemolysin-type calcium-binding protein [Paracoccus denitrificans PD1222] | 122 | 568 | 50% | 6e-25 | 31% | YP_914368.1 |
| rhizobiocin/RTX toxin and hemolysin-type calcium binding protein [Rhizobium etli CIAT 652] | 122 | 680 | 63% | 1e-24 | 30% | YP_001976973.1 |
| Na-Ca exchanger/integrin-beta4 [Leptothrix cholodnii SP-6] | 121 | 309 | 65% | 1e-24 | 30% | YP_001789672.1 |
| hypothetical protein AZOLI_p40606 [Azospirillum lipoferum 4B] | 122 | 801 | 66% | 2e-24 | 31% | YP_004975543.1 |
| hypothetical protein [Novispirillum itersonii] | 121 | 121 | 20% | 2e-24 | 35% | WP_019646374.1 |

*FIG. 3A*

| Description | Max score | Total score | Query cover | E value | Ident | Accession No. |
|---|---|---|---|---|---|---|
| rhizobiocin/RTX toxin and hemolysin-type calcium binding protein [Azospirillum sp. B510] | 120 | 298 | 63% | 3e-24 | 29% | YP_003450680.1 |
| hemolysin-type calcium-binding protein [Isosphaera pallida ATCC 43644] | 120 | 700 | 56% | 3e-24 | 30% | YP_004180362.1 |
| hypothetical protein NGR_c23240 [Sinorhizobium fredii NGR234] | 120 | 409 | 63% | 3e-24 | 29% | YP_002826836.1 |
| hemolysin-type calcium-binding protein [Rhizobium leguminosarum bv. trifolii WSM2304] | 120 | 445 | 61% | 4e-24 | 32% | YP_002281223.1 |
| hemolysin-type calcium-binding protein, partial [Thalassospira xiamenensis] | 120 | 823 | 64% | 5e-24 | 30% | WP_007088891.1 |
| hypothetical protein [Rhizobium sp. BR816] | 118 | 343 | 55% | 8e-24 | 32% | WP_018236938.1 |
| hemolysin-type calcium-binding protein [Nostoc sp. PCC 7107] | 117 | 272 | 62% | 1e-23 | 29% | YP_007052011.1 |
| hypothetical protein [Rhizobium sp. BR816] | 117 | 322 | 50% | 2e-23 | 30% | WP_018236607.1 |
| Hemolysin-type calcium-binding region [Rhodobacter sp. SW2] | 117 | 398 | 48% | 2e-23 | 33% | WP_008030394.1 |
| type I secretion protein [Pseudovibrio sp. JE062] | 117 | 318 | 63% | 2e-23 | 29% | WP_008548480.1 |
| Hemolysin-type calcium-binding region [Glaciecola sp. HTCC2999] | 118 | 950 | 61% | 2e-23 | 26% | WP_010180036.1 |
| Ca2+-binding protein, RTX toxin, partial [Rhizobium leguminosarum] | 117 | 426 | 63% | 3e-23 | 29% | WP_003545660.1 |
| hypothetical protein, partial [Endozoicomonas elysicola] | 117 | 1493 | 62% | 3e-23 | 28% | WP_020582427.1 |
| hypothetical protein [Methylovulum miyakonense] | 116 | 241 | 61% | 4e-23 | 29% | WP_019864974.1 |
| type I secretion protein with C-terminal target domain [Pseudomonas sp. GM74] | 115 | 115 | 42% | 4e-23 | 29% | WP_008047127.1 |
| type I secretion protein [Vibrio ichthyoenteri] | 116 | 346 | 49% | 5e-23 | 30% | WP_006714325.1 |
| hemolysin D [Sinorhizobium meliloti] | 115 | 399 | 56% | 6e-23 | 30% | WP_003532128.1 |
| hypothetical protein [Aliivibrio logei] | 115 | 301 | 48% | 8e-23 | 30% | WP_017023581.1 |
| hypothetical protein AZKH_2325 [Azoarcus sp. KH32C] | 115 | 499 | 63% | 8e-23 | 28% | YP_007551607.1 |
| Collagen alpha-2(I) chain Alpha-2 type I collagen [Sinorhizobium fredii HH103] | 115 | 160 | 63% | 8e-23 | 28% | YP_005189185.1 |
| Ca2+-binding protein, RTX toxin [Herbaspirillum sp. YR522] | 115 | 852 | 71% | 1e-22 | 28% | WP_008110911.1 |
| hemolysin-type calcium-binding protein [Methylovorus glucosetrophus SIP3-4] | 114 | 158 | 52% | 2e-22 | 29% | YP_003050467.1 |
| type I secretion protein [Vibrio sp. N418] | 114 | 456 | 49% | 3e-22 | 31% | WP_009385092.1 |
| hypothetical protein [Magnetospirillum sp. SO-1] | 114 | 672 | 78% | 4e-22 | 43% | WP_008614612.1 |
| hypothetical protein SFHH103_02192 [Sinorhizobium fredii HH103] | 112 | 471 | 64% | 8e-22 | 30% | YP_005189512.1 |
| hypothetical protein [Methylovulum miyakonense] | 112 | 645 | 61% | 1e-21 | 31% | WP_019867288.1 |
| Hemolysin-type calcium-binding domain-containing protein [Candidatus Accumulibacter phosphatis clade IIA str. UW-1] | 112 | 653 | 64% | 2e-21 | 28% | YP_003168877.1 |
| type I secretion protein [Vibrio scophthalmi] | 111 | 273 | 51% | 2e-21 | 30% | WP_005594452.1 |
| hypothetical protein [Pseudomonas alcaliphila] | 111 | 508 | 63% | 2e-21 | 28% | WP_017677435.1 |

*FIG. 3B*

| Description | Max score | Total score | Query cover | E value | Ident | Accession No. |
|---|---|---|---|---|---|---|
| type I secretion protein [Photobacterium profundum] | 110 | 417 | 62% | 3e-21 | 28% | WP_006231502.1 |
| rhizobiocin RzcA [Asticcacaulis biprosthecium] | 110 | 778 | 57% | 4e-21 | 29% | WP_006274635.1 |
| hemolysin-type calcium-binding protein [Chlorobium limicola DSM 245] | 110 | 678 | 68% | 4e-21 | 29% | YP_001944163.1 |
| rhizobiocin RzcA [Asticcacaulis biprosthecium] | 110 | 863 | 67% | 5e-21 | 29% | WP_006274634.1 |
| hemolysin-type calcium-binding region [Bradyrhizobium oligotrophicum S58] | 110 | 1221 | 76% | 6e-21 | 28% | YP_007511038.1 |
| FecR protein [Desulfovibrio aespoeensis Aspo-2] | 109 | 371 | 84% | 7e-21 | 27% | YP_004120097.1 |
| hemolysin-adenlyate cyclase [Sinorhizobium meliloti 1021] | 108 | 445 | 50% | 7e-21 | 29% | NP_436619.1 |
| hemolysin [Rhizobium sp. BR816] | 108 | 516 | 64% | 8e-21 | 29% | WP_018240167.1 |
| hemolysin-type calcium-binding protein [Sinorhizobium meliloti AK83] | 108 | 444 | 50% | 1e-20 | 29% | YP_004556664.1 |
| rhizobiocin/RTX toxin and hemolysin-type calcium binding protein [Rhizobium etli CFN 42] | 108 | 639 | 66% | 1e-20 | 28% | YP_468266.1 |
| hemolysin D [Sinorhizobium meliloti] | 108 | 300 | 50% | 1e-20 | 29% | WP_017265529.1 |
| hypothetical protein, partial [Magnetospirillum sp. SO-1] | 108 | 319 | 70% | 1e-20 | 31% | WP_008622436.1 |
| probabable type I secretion target repeat protein [Sinorhizobium meliloti SM11] | 108 | 442 | 50% | 1e-20 | 29% | YP_005723848.1 |
| hypothetical protein PCA10_43500 [Pseudomonas resinovorans NBRC 106553] | 108 | 212 | 51% | 1e-20 | 29% | YP_008104687.1 |
| hypothetical protein, partial [Acinetobacter beijerinckii] | 108 | 382 | 61% | 1e-20 | 28% | WP_005052115.1 |
| hypothetical protein [Oscillatoria sp. PCC 10802] | 107 | 485 | 50% | 1e-20 | 30% | WP_017717249.1 |
| hypothetical protein [Sphingobium yanoikuyae] | 108 | 303 | 63% | 2e-20 | 29% | WP_004210915.1 |
| hemolysin-type calcium-binding region, partial [Thalassospira xiamenensis] | 108 | 597 | 65% | 2e-20 | 29% | WP_007091705.1 |
| putative calcium binding hemolysin protein [Bradyrhizobium oligotrophicum S58] | 107 | 472 | 66% | 3e-20 | 29% | YP_007515571.1 |
| hemolysin D, partial [Sinorhizobium meliloti] | 106 | 383 | 47% | 4e-20 | 29% | WP_017274029.1 |
| hypothetical protein [Methylobacterium sp. 88A] | 106 | 246 | 61% | 4e-20 | 27% | WP_018043892.1 |
| putative calcium-binding protein, partial [Rhizobium leguminosarum] | 105 | 303 | 52% | 5e-20 | 29% | WP_003545662.1 |
| RTX toxins and related Ca2+-binding protein [alpha proteobacterium BAL199] | 106 | 106 | 51% | 5e-20 | 30% | WP_007675223.1 |
| hemolysin-type calcium-binding protein [Sinorhizobium meliloti BL225C] | 106 | 358 | 54% | 5e-20 | 30% | YP_005716684.1 |
| hemolysin D [Sinorhizobium meliloti] | 106 | 254 | 54% | 6e-20 | 30% | WP_017263229.1 |
| hypothetical protein, partial [Acinetobacter tjernbergiae] | 106 | 465 | 75% | 7e-20 | 28% | WP_018679436.1 |
| calcium binding hemolysin protein, putative [Erythrobacter sp. SD-21] | 106 | 648 | 59% | 8e-20 | 28% | WP_006833885.1 |
| rhizobiocin/RTX toxin and hemolysin-type calcium binding protein, partial [Rhizobium etli] | 105 | 316 | 52% | 9e-20 | 27% | WP_010060462.1 |
| Hemolysin-type calcium-binding region [Shewanella piezotolerans WP3] | 105 | 744 | 64% | 1e-19 | 29% | YP_002310757.1 |
| type I secretion target GGXGXDXXX repeat protein domain protein | 103 | 437 | 48% | 4e-19 | 28% | WP_006102484.1 |

*FIG. 3C*

| Description | Max score | Total score | Query cover | E value | Ident | Accession No. |
|---|---|---|---|---|---|---|
| [Coleofasciculus chthonoplastes] | | | | | | |
| hemolysin D [Sinorhizobium meliloti] | 103 | 381 | 56% | 4e-19 | 27% | WP_018095958.1 |
| rhizobiocin [Rhizobium leguminosarum bv. viciae 3841] | 103 | 536 | 63% | 5e-19 | 29% | YP_766400.1 |
| hemolysin-type calcium-binding protein [Desulfomicrobium baculatum DSM 4028] | 103 | 250 | 61% | 7e-19 | 28% | YP_003158921.1 |
| hemolysin [Sinorhizobium fredii NGR234] | 102 | 452 | 63% | 7e-19 | 27% | YP_002826449.1 |
| hemolysin-type calcium-binding repeat protein [Leptolyngbya sp. PCC 7375] | 103 | 511 | 63% | 7e-19 | 28% | WP_006519062.1 |
| calcium-binding protein [Acaryochloris sp. CCMEE 5410] | 102 | 540 | 62% | 9e-19 | 29% | WP_010480511.1 |
| hemolysin-type calcium-binding region [Rhodobacteraceae bacterium KLH11] | 102 | 519 | 61% | 2e-18 | 30% | WP_008758430.1 |
| hypothetical protein, partial [Nodularia spumigena] | 101 | 244 | 48% | 2e-18 | 27% | WP_017804098.1 |
| Collagen alpha-1(XXVII) chain [Sinorhizobium fredii HH103] | 101 | 364 | 63% | 2e-18 | 27% | YP_005189186.1 |

FIG. 3D

| Description | Max score | Total score | Query cover | E value | Ident | Accession No. |
|---|---|---|---|---|---|---|
| large exoprotein [Magnetospirillum magneticum AMB-1] | 10086 | 10086 | 100% | 0.0 | 100% | YP_420631.1 |
| Type V secretory pathway [Magnetospirillum magneticum AMB-1] | 5598 | 31637 | 95% | 0.0 | 94% | YP_420638.1 |
| Type V secretory pathway, adhesin AidA [Magnetospirillum magneticum AMB-1] | 2958 | 12311 | 90% | 0.0 | 97% | YP_421364.1 |
| VCBS repeat-containing protein [Desulfomonile tiedjei DSM 6799] | 2012 | 14277 | 86% | 0.0 | 46% | YP_006446912.1 |
| hypothetical protein, partial [Achromobacter piechaudii] | 1758 | 9327 | 77% | 0.0 | 45% | WP_006218690.1 |
| large exoprotein [Desulfovibrio sp. 3_1_syn3] | 1706 | 7674 | 90% | 0.0 | 34% | WP_008684592.1 |
| VCBS protein [Bilophila wadsworthia] | 1519 | 8397 | 87% | 0.0 | 35% | WP_016361080.1 |
| RTX toxin [Shewanella violacea DSS12] | 1445 | 4982 | 92% | 0.0 | 36% | YP_003558595.1 |
| VCBS [Dechloromonas aromatica RCB] | 1434 | 4571 | 67% | 0.0 | 39% | YP_286399.1 |
| outer membrane adhesin-like protein [Methylobacterium sp. 4-46] | 1360 | 5020 | 80% | 0.0 | 38% | YP_001770167.1 |
| VCBS repeat protein [Vibrio splendidus] | 1303 | 7811 | 89% | 0.0 | 34% | WP_004731498.1 |
| structural toxin [Chromobacterium violaceum ATCC 12472] | 1280 | 6732 | 95% | 0.0 | 37% | NP_899981.1 |
| iron-regulated protein FrpC [Vibrio rotiferianus] | 1248 | 4663 | 92% | 0.0 | 34% | WP_010452358.1 |
| hypothetical protein AHA_3491 [Aeromonas hydrophila subsp. hydrophila ATCC 7966] | 1240 | 2434 | 65% | 0.0 | 40% | YP_857965.1 |
| MadA [Mesorhizobium sp. R88B] | 1238 | 3594 | 85% | 0.0 | 39% | ABM65821.1 |
| secreted VCBS domain protein [Shewanella oneidensis MR-1] | 1201 | 15090 | 90% | 0.0 | 35% | NP_719678.1 |
| iron-regulated protein FrpC [Vibrio fischeri MJ11] | 1185 | 6646 | 90% | 0.0 | 34% | YP_002156318.1 |
| RTX repeat-containing calcium-binding cytotoxin RtxA1 [Vibrio fischeri ES114] | 1172 | 6610 | 89% | 0.0 | 34% | YP_204889.1 |
| Large exoprotein [Vibrio furnissii NCTC 11218] | 1158 | 6670 | 94% | 0.0 | 43% | YP_005048901.1 |
| hypothetical protein RPB_1638 [Rhodopseudomonas palustris HaA2] | 1149 | 9056 | 93% | 0.0 | 46% | YP_485257.1 |
| RTX toxin [Aliivibrio fischeri] | 1144 | 4512 | 87% | 0.0 | 33% | WP_005419658.1 |
| cell surface glycoprotein precursor [Magnetospirillum magneticum AMB-1] | 1111 | 15837 | 88% | 0.0 | 99% | YP_421356.1 |
| iron-regulated protein FrpC [Vibrio tubiashii] | 1110 | 4979 | 84% | 0.0 | 35% | WP_004747418.1 |
| VCBS repeat-containing protein [Pseudomonas sp. GM21] | 1087 | 11274 | 87% | 0.0 | 33% | WP_007942972.1 |
| iron-regulated protein FrpC [Vibrio shilonii] | 1060 | 3937 | 87% | 0.0 | 32% | WP_006070242.1 |
| T1SS secreted agglutinin (RTX) [Achromobacter xylosoxidans NH44784-1996] | 1011 | 4297 | 87% | 0.0 | 44% | YP_008030908.1 |
| hypothetical protein Sden_0384 [Shewanella denitrificans OS217] | 1016 | 2508 | 59% | 0.0 | 36% | YP_561402.1 |
| hypothetical protein [Vibrio natriegens] | 1005 | 5432 | 89% | 0.0 | 32% | WP_020334262.1 |
| hypothetical protein, partial [Pseudomonas sp. 35MFCvii.1] | 998 | 2395 | 85% | 0.0 | 32% | WP_020621311.1 |
| hypothetical protein [Vibrio splendidus] | 992 | 9722 | 90% | 0.0 | 34% | WP_017082048.1 |
| hypothetical protein, partial [Oxalobacteraceae bacterium JGI 0001004-K23] | 965 | 6950 | 86% | 0.0 | 36% | WP_018058402.1 |

*FIG. 4A*

| Description | Max score | Total score | Query cover | E value | Ident | Accession No. |
|---|---|---|---|---|---|---|
| outer membrane adhesin like protein [Variovorax paradoxus S110] | 888 | 5136 | 79% | 0.0 | 38% | YP_002947797.1 |
| hypothetical protein, partial [Aliivibrio logei] | 895 | 6776 | 92% | 0.0 | 32% | WP_017021259.1 |
| hypothetical protein Plut_0676 [Chlorobium luteolum DSM 273] | 905 | 3584 | 82% | 0.0 | 32% | YP_374597.1 |
| hypothetical protein, partial [Aliivibrio fischeri] | 885 | 4569 | 86% | 0.0 | 32% | WP_017019291.1 |
| hypothetical protein, partial [Enterovibrio calviensis] | 861 | 5168 | 85% | 0.0 | 34% | WP_017011038.1 |
| iron-regulated protein FrpC, partial [Vibrio nigripulchritudo] | 865 | 7506 | 85% | 0.0 | 34% | WP_004400669.1 |
| hypothetical protein, partial [Desulfovibrio sp. 6_1_46AFAA] | 838 | 7019 | 89% | 0.0 | 35% | WP_009301783.1 |
| hypothetical protein [Vibrio tasmaniensis] | 838 | 5072 | 87% | 0.0 | 35% | WP_017109466.1 |
| hypothetical protein, partial [Pseudomonas umsongensis] | 808 | 2556 | 84% | 0.0 | 33% | WP_018926333.1 |
| VCBS [Chlorobium ferrooxidans] | 796 | 6644 | 88% | 0.0 | 39% | WP_006366861.1 |
| outer membrane adhesin-like protein [Shewanella loihica PV-4] | 789 | 5554 | 88% | 0.0 | 40% | YP_001092641.1 |
| VCBS repeat protein [Shewanella piezotolerans WP3] | 790 | 7524 | 91% | 0.0 | 36% | YP_002313811.1 |
| hypothetical protein, partial [Vibrio tasmaniensis] | 748 | 7602 | 87% | 0.0 | 35% | WP_017099027.1 |
| hypothetical protein [Vibrio owensii] | 768 | 5374 | 69% | 0.0 | 31% | WP_020195639.1 |
| hypothetical protein VS_II0512 [Vibrio splendidus LGP32] | 754 | 4627 | 83% | 0.0 | 34% | YP_002395108.1 |
| cell surface glycoprotein precursor [Magnetospirillum magneticum AMB-1] | 665 | 16303 | 87% | 0.0 | 91% | YP_421357.1 |
| toxin [Vibrio sp. MED222] | 737 | 4790 | 78% | 0.0 | 32% | WP_009845528.1 |
| hypothetical protein, partial [Enterovibrio calviensis] | 707 | 2841 | 83% | 0.0 | 33% | WP_017017027.1 |
| hypothetical protein, partial [Enterovibrio norvegicus] | 707 | 4934 | 88% | 0.0 | 35% | WP_017003860.1 |
| hypothetical protein PCA10_42970 [Pseudomonas resinovorans NBRC 106553] | 694 | 5353 | 88% | 0.0 | 36% | WP_017102899.1 |
| COG5295: Autotransporter adhesin [Magnetospirillum magnetotacticum] | 709 | 3950 | 70% | 0.0 | 52% | WP_009869454.1 |
| flagellin-like protein [Magnetospirillum magneticum AMB-1] | 635 | 24960 | 85% | 0.0 | 83% | YP_421362.1 |
| hypothetical protein, partial [Vibrio genomosp. F6] | 689 | 3809 | 62% | 0.0 | 33% | WP_017053340.1 |
| hypothetical protein PCA10_42970 [Pseudomonas resinovorans NBRC 106553] | 703 | 1746 | 90% | 0.0 | 29% | YP_008104634.1 |
| type 1 secretion target domain-containing protein, partial [Rhizobium sp. PDO1-076] | 673 | 5887 | 84% | 0.0 | 40% | WP_007606142.1 |
| iron-regulated protein FrpC, partial [Vibrio tubiashii] | 682 | 6239 | 84% | 0.0 | 32% | WP_004749162.1 |
| hypothetical protein, partial [Vibrio breoganii] | 690 | 5398 | 90% | 0.0 | 29% | WP_017243041.1 |
| hypothetical protein, partial [Magnetospirillum magnetotacticum] | 631 | 9349 | 85% | 0.0 | 57% | WP_009868025.1 |
| hypothetical protein, partial [Enterovibrio calviensis] | 668 | 2259 | 85% | 0.0 | 33% | WP_017015203.1 |
| RTX toxin [Vibrio sp. EJY3] | 667 | 5392 | 86% | 0.0 | 32% | YP_005025033.1 |
| hypothetical protein [Vibrio tubiashii] | 667 | 4513 | 87% | 0.0 | 31% | WP_004744158.1 |
| hypothetical protein [Vibrio breoganii] | 653 | 8014 | 89% | 0.0 | 31% | WP_017029498.1 |

*FIG. 4B*

| Description | Max score | Total score | Query cover | E value | Ident | Accession No. |
|---|---|---|---|---|---|---|
| VCBS repeat protein [Vibrio shilonii] | 643 | 4858 | 87% | 0.0 | 29% | WP_006072371.1 |
| hypothetical protein, partial [Sulfurimonas gotlandica] | 624 | 6822 | 90% | 0.0 | 36% | WP_008340241.1 |
| biofilm-associated surface protein [Vibrio parahaemolyticus RIMD 2210633] | 632 | 4064 | 79% | 0.0 | 35% | NP_800463.1 |
| RTX toxin exported protein RtxA [Cupriavidus necator N-1] | 630 | 2948 | 58% | 3e-180 | 39% | YP_004680854.1 |
| toxin, partial [Vibrio splendidus] | 631 | 5002 | 88% | 3e-179 | 31% | WP_017092000.1 |
| outer membrane adhesin-like protein [Shewanella woodyi ATCC 51908] | 632 | 1130 | 43% | 5e-179 | 33% | YP_001758872.1 |
| outer membrane adhesin-like protein [Calothrix sp. PCC 7507] | 625 | 4740 | 76% | 1e-178 | 41% | YP_007065062.1 |
| hypothetical protein, partial [Vibrio splendidus] | 609 | 5290 | 89% | 7e-177 | 34% | WP_017081492.1 |
| hypothetical protein [Vibrionales bacterium SWAT-3] | 613 | 4587 | 88% | 1e-172 | 31% | WP_008216195.1 |
| outer membrane adhesin-like protein [Sulfurimonas gotlandica] | 592 | 5281 | 90% | 1e-171 | 36% | WP_008341635.1 |
| VBCS repeat-containing protein [Colwellia psychrerythraea 34H] | 609 | 3630 | 90% | 2e-171 | 28% | YP_269146.1 |
| hypothetical protein, partial [Variovorax paradoxus] | 563 | 8220 | 83% | 2e-169 | 41% | WP_018907567.1 |
| hypothetical protein [Desulfovibrio sp. 6_1_46AFAA] | 586 | 4127 | 88% | 1e-168 | 32% | WP_009301782.1 |
| VBCS repeat-containing protein [Vibrio scophthalmi] | 592 | 5438 | 89% | 2e-166 | 29% | WP_005594382.1 |
| outer membrane adhesin-like protein [Desulfovibrio aespoeensis Aspo-2] | 585 | 2905 | 69% | 3e-164 | 34% | YP_004120666.1 |
| hypothetical protein [Vibrio splendidus] | 575 | 4781 | 83% | 2e-161 | 29% | WP_019825879.1 |
| outer membrane adhesin-like protein [Shewanella baltica BA175] | 544 | 2992 | 86% | 1e-158 | 39% | YP_006019007.1 |
| Large exoprotein, partial [Achromobacter piechaudii] | 531 | 4718 | 87% | 1e-157 | 45% | WP_006228189.1 |
| hypothetical protein AZKH_2157 [Azoarcus sp. KH32C] | 559 | 2386 | 87% | 5e-157 | 32% | YP_007551444.1 |
| hypothetical protein, partial [Vibrio breoganii] | 520 | 8003 | 83% | 2e-154 | 44% | WP_017031543.1 |
| outer membrane adhesin-like protein [Shewanella loihica PV-4] | 550 | 789 | 73% | 4e-153 | 29% | YP_001092444.1 |
| outer membrane adhesin-like protein [Shewanella woodyi ATCC 51908] | 548 | 2148 | 69% | 4e-153 | 31% | YP_001758871.1 |
| RTX toxin [Shewanella violacea DSS12] | 540 | 2178 | 75% | 1e-150 | 31% | YP_003558594.1 |
| COG2931: RTX toxins and related Ca2+-binding proteins [Magnetospirillum magnetotacticum] | 531 | 2545 | 50% | 2e-150 | 49% | WP_009868027.1 |
| VCBS repeat-containing protein [Bradyrhizobium sp. WSM471] | 530 | 4756 | 81% | 2e-150 | 44% | WP_007606711.1 |
| Type V secretory pathway, partial [Vibrionales bacterium SWAT-3] | 500 | 7321 | 87% | 2e-147 | 42% | WP_008224673.1 |
| hypothetical protein [Kordiimonas gwangyangensis] | 524 | 2060 | 61% | 1e-146 | 43% | WP_020398403.1 |
| Large exoprotein, partial [Achromobacter piechaudii] | 494 | 4610 | 85% | 9e-145 | 45% | WP_006228197.1 |
| RTX toxin hemolysin-type protein [Rhizobium etli CFN 42] | 503 | 5109 | 87% | 1e-144 | 37% | YP_470132.1 |
| hypothetical protein Reut_C5971 [Ralstonia eutropha JMP134] | 508 | 5154 | 90% | 4e-143 | 38% | YP_293166.1 |
| hypothetical protein [Achromobacter xylosoxidans] | 474 | 6194 | 87% | 3e-141 | 45% | WP_006387942.1 |

*FIG. 4C*

| Description | Max score | Total score | Query cover | E value | Ident | Accession No. |
|---|---|---|---|---|---|---|
| VCBS [Chlorobium ferrooxidans] >gb EAT58497.1: VCBS [Chlorobium ferrooxidans DSM 13031] | 498 | 2074 | 53% | 8e-141 | 40% | WP_006366860.1 |
| hypothetical protein, partial [Vibrio splendidus] | 506 | 2630 | 82% | 3e-140 | 28% | WP_017077555.1 |
| hypothetical protein, partial [Vibrio breoganii] | 482 | 5025 | 85% | 1e-139 | 38% | WP_017029526.1 |
| hypothetical protein [Vibrio coralliilyticus] | 496 | 3596 | 85% | 4e-137 | 29% | WP_006962234.1 |
| Type V secretory pathway, partial [Vibrionales bacterium SWAT-3] | 458 | 7873 | 88% | 1e-136 | 51% | WP_008223511.1 |
| hypothetical protein bll3714 [Bradyrhizobium diazoefficiens USDA 110] | 482 | 2856 | 41% | 8e-133 | 38% | NP_770354.1 |

FIG. 4D

| Description | Max score | Total score | Query cover | E value | Ident | Accession No. |
|---|---|---|---|---|---|---|
| Type V secretory pathway [Magnetospirillum magneticum AMB-1] | 6895 | 6895 | 100% | 0.0 | 100% | YP_420638.1 |
| large exoprotein [Magnetospirillum magneticum AMB-1] | 5612 | 31712 | 92% | 0.0 | 94% | YP_420631.1 |
| Type V secretory pathway, adhesin AidA [Magnetospirillum magneticum AMB-1] | 2065 | 9344 | 87% | 0.0 | 96% | YP_421364.1 |
| VCBS repeat-containing protein [Desulfomonile tiedjei DSM 6799] | 1810 | 6831 | 83% | 0.0 | 45% | YP_006446912.1 |
| hypothetical protein, partial [Achromobacter piechaudii] | 1673 | 3568 | 89% | 0.0 | 43% | WP_006218690.1 |
| VCBS [Dechloromonas aromatica RCB] >ref|WP_011288925.1| VCBS [Dechloromonas aromatica] | 1451 | 4700 | 84% | 0.0 | 39% | YP_286399.1 |
| cell surface glycoprotein precursor [Magnetospirillum magneticum AMB-1] | 1398 | 11419 | 87% | 0.0 | 100% | YP_421356.1 |
| outer membrane adhesin-like protein [Methylobacterium sp. 4-46] | 1347 | 3611 | 80% | 0.0 | 38% | YP_001770167.1 |
| structural toxin [Chromobacterium violaceum ATCC 12472] | 1293 | 3871 | 88% | 0.0 | 38% | NP_899981.1 |
| VCBS repeat protein [Vibrio splendidus] | 1199 | 4321 | 81% | 0.0 | 35% | WP_004731498.1 |
| large exoprotein [Desulfovibrio sp. 3_1_syn3] | 1168 | 5537 | 82% | 0.0 | 34% | WP_008684592.1 |
| hypothetical protein AHA_3491 [Aeromonas hydrophila subsp. hydrophila ATCC 7966] | 1164 | 3229 | 85% | 0.0 | 40% | YP_857965.1 |
| Large exoprotein [Vibrio furnissii NCTC 11218] | 1137 | 4348 | 87% | 0.0 | 47% | YP_005048901.1 |
| VCBS protein [Bilophila wadsworthia] >gb|EPC05682.1| | 1118 | 9652 | 87% | 0.0 | 34% | WP_016361080.1 |
| secreted VCBS domain protein [Shewanella oneidensis MR-1] | 1111 | 7756 | 85% | 0.0 | 35% | NP_719678.1 |
| iron-regulated protein FrpC [Vibrio tubiashii] | 1092 | 3731 | 80% | 0.0 | 35% | WP_004747418.1 |
| RTX toxin [Shewanella violacea DSS12] | 1069 | 5469 | 85% | 0.0 | 35% | YP_003558595.1 |
| T1SS secreted agglutinin (RTX) [Achromobacter xylosoxidans NH44784-1996] | 1016 | 3734 | 88% | 0.0 | 44% | YP_008030908.1 |
| hypothetical protein RPB_1638 [Rhodopseudomonas palustris HaA2] | 1041 | 2369 | 82% | 0.0 | 41% | YP_485257.1 |
| hypothetical protein Sden_0384 [Shewanella denitrificans OS217] | 1013 | 3119 | 82% | 0.0 | 36% | YP_561402.1 |
| RTX repeat-containing calcium-binding cytotoxin RtxA1 [Vibrio fischeri ES114] | 1004 | 1986 | 84% | 0.0 | 33% | YP_204889.1 |
| iron-regulated protein FrpC [Vibrio fischeri MJ11] | 991 | 6052 | 89% | 0.0 | 32% | YP_002156318.1 |
| hypothetical protein, partial [Oxalobacteraceae bacterium JGI 0001004-K23] | 976 | 2447 | 86% | 0.0 | 36% | WP_018058402.1 |
| RTX toxin [Aliivibrio fischeri] | 981 | 2915 | 89% | 0.0 | 33% | WP_005419658.1 |
| VCBS repeat-containing protein [Pseudomonas sp. GM21] | 974 | 5340 | 83% | 0.0 | 33% | WP_007942972.1 |
| iron-regulated protein FrpC [Vibrio rotiferianus] | 978 | 2883 | 88% | 0.0 | 34% | WP_010452358.1 |
| hypothetical protein [Vibrio splendidus] | 978 | 5373 | 82% | 0.0 | 34% | WP_017082048.1 |
| MadA [Mesorhizobium sp. R88B] | 966 | 2463 | 86% | 0.0 | 39% | ABM65821.1 |
| outer membrane adhesin like protein [Variovorax paradoxus S110] | 885 | 4564 | 80% | 0.0 | 38% | YP_002947797.1 |
| hypothetical protein [Vibrio natriegens] | 896 | 2536 | 84% | 0.0 | 32% | WP_020334262.1 |

*FIG. 5A*

| Description | Max score | Total score | Query cover | E value | Ident | Accession No. |
|---|---|---|---|---|---|---|
| iron-regulated protein FrpC [Vibrio shilonii] | 893 | 2962 | 87% | 0.0 | 31% | WP_006070242.1 |
| hypothetical protein, partial [Aliivibrio fischeri] | 879 | 2558 | 86% | 0.0 | 32% | WP_017019291.1 |
| iron-regulated protein FrpC, partial [Vibrio nigripulchritudo] | 862 | 4903 | 80% | 0.0 | 34% | WP_004400669.1 |
| hypothetical protein, partial [Enterovibrio calviensis] | 847 | 3923 | 84% | 0.0 | 34% | WP_017011038.1 |
| hypothetical protein, partial [Aliivibrio logei] | 860 | 2391 | 89% | 0.0 | 31% | WP_017021259.1 |
| hypothetical protein, partial [Desulfovibrio sp. 6_1_46AFAA] | 835 | 7361 | 82% | 0.0 | 35% | WP_009301783.1 |
| hypothetical protein, partial [Pseudomonas sp. 35MFCvil.1] | 855 | 2870 | 83% | 0.0 | 32% | WP_020621311.1 |
| COG5295: Autotransporter adhesin [Magnetospirillum magnetotacticum] | 847 | 2549 | 87% | 0.0 | 50% | WP_009869454.1 |
| hypothetical protein [Vibrio tasmaniensis] | 835 | 4468 | 81% | 0.0 | 35% | WP_017109466.1 |
| hypothetical protein, partial [Pseudomonas umsongensis] | 800 | 2758 | 80% | 0.0 | 33% | WP_018926333.1 |
| hypothetical protein Plut_0676 [Chlorobium luteolum DSM 273] | 810 | 3074 | 75% | 0.0 | 34% | YP_374597.1 |
| outer membrane adhesin-like protein [Shewanella loihica PV-4] | 783 | 3547 | 85% | 0.0 | 40% | YP_001092641.1 |
| VCBS [Chlorobium ferrooxidans] | 784 | 5024 | 81% | 0.0 | 38% | WP_006366861.1 |
| VCBS repeat protein [Shewanella piezotolerans WP3] | 783 | 5217 | 89% | 0.0 | 36% | YP_002313811.1 |
| COG2931: RTX toxins and related Ca2+-binding proteins [Magnetospirillum magnetotacticum] | 746 | 3446 | 60% | 0.0 | 55% | WP_009868027.1 |
| hypothetical protein VS_II0512 [Vibrio splendidus LGP32] > | 762 | 3064 | 82% | 0.0 | 33% | YP_002395108.1 |
| hypothetical protein, partial [Vibrio tasmaniensis] | 744 | 5366 | 84% | 0.0 | 35% | WP_017099027.1 |
| hypothetical protein, partial [Vibrio tasmaniensis] | 734 | 4232 | 85% | 0.0 | 36% | WP_017102899.1 |
| hypothetical protein [Vibrio owensii] | 754 | 2886 | 80% | 0.0 | 31% | WP_020195639.1 |
| cell surface glycoprotein precursor [Magnetospirillum magneticum AMB-1] | 669 | 10927 | 82% | 0.0 | 94% | YP_421357.1 |
| toxin [Vibrio sp. MED222] | 735 | 2929 | 83% | 0.0 | 33% | WP_009845528.1 |
| hypothetical protein, partial [Enterovibrio norvegicus] | 710 | 4623 | 81% | 0.0 | 35% | WP_017003860.1 |
| hypothetical protein PCA10_42970 [Pseudomonas resinovorans NBRC 106553] | 728 | 877 | 83% | 0.0 | 31% | YP_008104634.1 |
| RTX toxin exported protein RtxA [Cupriavidus necator N-1] | 710 | 2660 | 90% | 0.0 | 36% | YP_004680854.1 |
| hypothetical protein [Vibrio breoganii] | 717 | 3466 | 83% | 0.0 | 29% | WP_017029498.1 |
| flagellin-like protein [Magnetospirillum magneticum AMB-1] | 636 | 15101 | 79% | 0.0 | 83% | YP_421362.1 |
| type 1 secretion target domain-containing protein, partial [Rhizobium sp. PDO1-076] | 672 | 4527 | 73% | 0.0 | 40% | WP_007606142.1 |
| hypothetical protein, partial [Vibrio genomosp. F6] | 681 | 6195 | 81% | 0.0 | 32% | WP_017053340.1 |
| hypothetical protein, partial [Enterovibrio calviensis] | 671 | 6495 | 77% | 0.0 | 33% | WP_017015203.1 |
| hypothetical protein, partial [Magnetospirillum magnetotacticum] | 634 | 8403 | 80% | 0.0 | 58% | WP_009868025.1 |
| hypothetical protein, partial [Vibrio breoganii] | 686 | 3666 | 85% | 0.0 | 29% | WP_017243041.1 |

*FIG. 5B*

| Description | Max score | Total score | Query cover | E value | Ident | Accession No. |
|---|---|---|---|---|---|---|
| iron-regulated protein FrpC, partial [Vibrio tubiashii] | 668 | 3859 | 79% | 0.0 | 32% | WP_004749162.1 |
| RTX toxin [Vibrio sp. EJY3] | 674 | 3458 | 84% | 0.0 | 33% | YP_005025033.1 |
| hypothetical protein [Vibrio tubiashii] | 661 | 3112 | 83% | 0.0 | 30% | WP_004744158.1 |
| hypothetical protein, partial [Enterovibrio calviensis] | 639 | 1195 | 78% | 0.0 | 32% | WP_017017027.1 |
| outer membrane adhesin-like protein [Shewanella woodyi ATCC 51908] | 648 | 1694 | 62% | 0.0 | 33% | YP_001758872.1 |
| outer membrane adhesin-like protein [Calothrix sp. PCC 7507] | 628 | 4317 | 84% | 3e-180 | 42% | YP_007065062.1 |
| biofilm-associated surface protein [Vibrio parahaemolyticus RIMD 2210633] | 626 | 2237 | 83% | 2e-179 | 35% | NP_800463.1 |
| toxin, partial [Vibrio splendidus] | 623 | 4290 | 83% | 3e-177 | 31% | WP_017092000.1 |
| VCBS repeat protein [Vibrio shilonii] | 620 | 3907 | 84% | 3e-175 | 28% | WP_006072371.1 |
| hypothetical protein, partial [Sulfurimonas gotlandica] | 601 | 2983 | 52% | 1e-174 | 40% | WP_008340241.1 |
| hypothetical protein [Vibrionales bacterium SWAT-3] | 617 | 3055 | 80% | 2e-174 | 31% | WP_008216195.1 |
| hypothetical protein, partial [Vibrio splendidus] | 598 | 2563 | 80% | 1e-173 | 34% | WP_017081492.1 |
| VBCS repeat-containing protein [Colwellia psychrerythraea 34H] | 607 | 2638 | 82% | 2e-171 | 28% | YP_269146.1 |
| hypothetical protein, partial [Variovorax paradoxus] | 560 | 3541 | 77% | 8e-169 | 40% | WP_018907567.1 |
| outer membrane adhesin-like protein [Desulfovibrio aespoeensis Aspo-2] | 592 | 2175 | 86% | 6e-167 | 34% | YP_004120666.1 |
| hypothetical protein [Desulfovibrio sp. 6_1_46AFAA] | 576 | 1697 | 78% | 7e-166 | 33% | WP_009301782.1 |
| outer membrane adhesin-like protein [Sulfurimonas gotlandica] | 572 | 1212 | 53% | 2e-165 | 39% | WP_008341635.1 |
| VBCS repeat-containing protein [Vibrio scophthalmi] | 578 | 3121 | 80% | 9e-163 | 29% | WP_005594382.1 |
| hypothetical protein [Vibrio splendidus] | 571 | 3250 | 85% | 1e-160 | 29% | WP_019825879.1 |
| outer membrane adhesin-like protein [Shewanella baltica BA175] | 546 | 1960 | 80% | 7e-160 | 39% | YP_006019007.1 |
| Large exoprotein, partial [Achromobacter piechaudii] | 530 | 4054 | 81% | 2e-157 | 45% | WP_006228189.1 |
| hypothetical protein, partial [Vibrio breoganii] | 523 | 6044 | 76% | 5e-156 | 44% | WP_017031543.1 |
| RTX toxin [Shewanella violacea DSS12] | 555 | 2108 | 77% | 1e-155 | 31% | YP_003558594.1 |
| outer membrane adhesin-like protein [Shewanella woodyi ATCC 51908]] | 540 | 2704 | 81% | 6e-151 | 30% | YP_001758871.1 |
| hypothetical protein AZKH_2157 [Azoarcus sp. KH32C] | 537 | 2180 | 90% | 1e-150 | 33% | YP_007551444.1 |
| outer membrane adhesin-like protein [Shewanella loihica PV-4] | 537 | 674 | 89% | 6e-150 | 30% | YP_001092444.1 |
| VCBS repeat-containing protein [Bradyrhizobium sp. WSM471] | 527 | 1903 | 72% | 1e-149 | 44% | WP_007606711.1 |
| Type V secretory pathway, partial [Vibrionales bacterium SWAT-3] | 505 | 4894 | 85% | 1e-149 | 45% | WP_008224673.1 |
| hypothetical protein [Kordiimonas gwangyangensis] | 529 | 1823 | 77% | 1e-148 | 44% | WP_020398403.1 |
| Large exoprotein, partial [Achromobacter piechaudii] | 495 | 3024 | 79% | 1e-145 | 45% | WP_006228197.1 |
| RTX toxin hemolysin-type protein [Rhizobium etli CFN 42] | 500 | 2327 | 68% | 2e-144 | 38% | YP_470132.1 |
| hypothetical protein Reut_C5971 [Ralstonia eutropha JMP134] | 501 | 1866 | 85% | 6e-141 | 38% | YP_293166.1 |

FIG. 5C

| Description | Max score | Total score | Query cover | E value | Ident | Accession No. |
|---|---|---|---|---|---|---|
| hypothetical protein [Achromobacter xylosoxidans] | 472 | 3451 | 83% | 6e-141 | 44% | WP_006387942.1 |
| Type V secretory pathway, partial [Vibrionales bacterium SWAT-3] | 466 | 4572 | 83% | 1e-139 | 51% | WP_008223511.1 |
| hypothetical protein, partial [Vibrio tasmaniensis] | 475 | 5374 | 79% | 4e-139 | 40% | WP_017101375.1 |
| VCBS [Chlorobium ferrooxidans] | 491 | 1870 | 80% | 4e-139 | 39% | WP_006366860.1 |
| hypothetical protein, partial [Vibrio breoganii] | 476 | 3784 | 82% | 6e-138 | 38% | WP_017029526.1 |
| hypothetical protein, partial [Vibrio splendidus] | 490 | 2879 | 83% | 1e-135 | 28% | WP_017077555.1 |
| hypothetical protein [Vibrio coralliilyticus] | 489 | 2158 | 71% | 2e-135 | 29% | WP_006962234.1 |

*FIG. 5D*

| Description | Max score | Total score | Query cover | E value | Ident | Accession No. |
|---|---|---|---|---|---|---|
| RTX toxins and related Ca2+-binding protein [Magnetospirillum magneticum AMB-1] | 2448 | 2448 | 100% | 0.0 | 100% | YP_422662.1 |
| RTX toxin [Magnetospirillum sp. SO-1] >gb:EME70692.1| RTX toxin [Magnetospirillum sp. SO-1] | 437 | 754 | 55% | 3e-126 | 57% | WP_008615895.1 |
| RTX toxins and related Ca2+-binding protein [Magnetospirillum magneticum AMB-1] | 407 | 407 | 32% | 8e-117 | 63% | YP_423419.1 |
| COG4254: Uncharacterized protein conserved in bacteria [Magnetospirillum magnetotacticum] | 332 | 332 | 16% | 1e-100 | 80% | WP_009869323.1 |
| COG2931: RTX toxins and related Ca2+-binding proteins [Magnetospirillum magnetotacticum] | 232 | 408 | 55% | 7e-59 | 38% | WP_009869271.1 |
| protein conserved in bacteria [Magnetospirillum gryphiswaldense MSR-1] | 170 | 170 | 9% | 5e-45 | 66% | CAM74103.1 |
| proprotein convertase P [Beijerinckia indica subsp. indica ATCC 9039] | 131 | 402 | 29% | 1e-27 | 34% | YP_001830991.1 |
| protein conserved in bacteria [Magnetospirillum gryphiswaldense MSR-1] | 124 | 124 | 11% | 2e-26 | 47% | CAM76248.1 |
| RTX toxins and related Ca2+-binding proteins [Magnetospirillum gryphiswaldense MSR-1] | 124 | 224 | 19% | 9e-26 | 53% | CAM75368.1 |
| hypothetical protein [Novispirillum itersonii] | 123 | 123 | 21% | 4e-25 | 36% | WP_019646374.1 |
| rhizobiocin RzcA [Ahrensia sp. R2A130] | 114 | 504 | 42% | 3e-22 | 32% | WP_009758714.1 |
| hypothetical protein [Magnetospirillum sp. SO-1] | 110 | 415 | 59% | 4e-21 | 43% | WP_008614612.1 |
| calcium binding hemolysin protein [Thalassospira profundimaris] | 110 | 1342 | 37% | 5e-21 | 31% | WP_008888391.1 |
| hypothetical protein [Oscillatoria sp. PCC 10802] | 109 | 291 | 36% | 9e-21 | 31% | WP_017719322.1 |
| hemolysin-type calcium-binding repeat family protein [Micavibrio aeruginosavorus ARL-13] | 104 | 152 | 31% | 2e-19 | 32% | YP_004866759.1 |
| Hemolysin-type calcium-binding region [Micavibrio aeruginosavorus EPB] | 103 | 278 | 37% | 5e-19 | 30% | YP_007642128.1 |
| calcium binding hemolysin protein, putative [Oceanicola granulosus] | 102 | 434 | 54% | 1e-18 | 31% | WP_007254292.1 |
| Hemolysin-type calcium-binding region [Methylosinus trichosporium] | 99.0 | 99.0 | 30% | 3e-18 | 31% | WP_003615611.1 |
| hemolysin-type calcium-binding protein [Sinorhizobium meliloti AK83] | 99.4 | 541 | 34% | 7e-18 | 29% | YP_004556664.1 |
| hypothetical protein [Rhodobacter sp. AKP1] | 99.8 | 316 | 31% | 8e-18 | 31% | WP_009564177.1 |
| regulatory P domain of subtilisin-like proprotein convertases [Nostoc sp. PCC 7524] | 99.0 | 368 | 33% | 1e-17 | 30% | YP_007076420.1 |
| hemolysin-adenylyate cyclase [Sinorhizobium meliloti 1021] | 98.6 | 501 | 34% | 1e-17 | 29% | NP_436619.1 |
| putative calcium-binding protein [Nostoc sp. PCC 7524] | 97.4 | 190 | 32% | 1e-17 | 31% | YP_007076007.1 |
| probabable type I secretion target repeat protein [Sinorhizobium meliloti SM11] | 98.2 | 543 | 34% | 1e-17 | 29% | YP_005723848.1 |
| Hemolysin-type calcium-binding region [Glaciecola sp. HTCC2999] | 98.6 | 1034 | 40% | 2e-17 | 32% | WP_010180036.1 |

FIG. 6A

| Description | Max score | Total score | Query cover | E value | Ident | Accession No. |
|---|---|---|---|---|---|---|
| Hemolysin-type calcium-binding region, RTX [Rhodobacter sphaeroides KD131] | 97.8 | 246 | 36% | 2e-17 | 31% | YP_002520640.1 |
| hypothetical protein [Methylovulum miyakonense] | 97.4 | 591 | 29% | 3e-17 | 32% | WP_019867288.1 |
| hemolysin D [Sinorhizobium meliloti] | 97.1 | 517 | 34% | 4e-17 | 28% | WP_018095958.1 |
| hemolysin-type calcium-binding protein [Paracoccus denitrificans PD1222] | 96.7 | 143 | 30% | 5e-17 | 29% | YP_914368.1 |
| hypothetical protein, partial [Endozoicomonas elysicola] | 96.3 | 1326 | 35% | 9e-17 | 34% | WP_020582427.1 |
| Hemolysin-type calcium-binding protein [Sinorhizobium medicae WSM419] | 94.7 | 407 | 32% | 2e-16 | 37% | YP_001312798.1 |
| outer membrane adhesin-like protein [Rhodobacter sphaeroides ATCC 17029] | 94.7 | 151 | 30% | 2e-16 | 29% | YP_001045054.1 |
| adhesin [Rhodobacter sphaeroides] | 94.4 | 94.4 | 30% | 3e-16 | 29% | WP_002724414.1 |
| adhesin [Rhodobacter sphaeroides] | 94.0 | 152 | 30% | 5e-16 | 30% | WP_017140389.1 |
| hemolysin D [Sinorhizobium meliloti] | 92.8 | 408 | 32% | 7e-16 | 28% | WP_003532128.1 |
| hemolysin-type calcium-binding region [Rhodobacteraceae bacterium KLH11] | 92.8 | 549 | 34% | 9e-16 | 29% | WP_008758430.1 |
| proprotein convertase P [Cyanothece sp. PCC 7822] | 92.0 | 244 | 30% | 9e-16 | 30% | YP_003886691.1 |
| hemolysin-type calcium-binding region [Roseibium sp. TrichSKD4] | 91.3 | 1162 | 45% | 3e-15 | 31% | WP_009467822.1 |
| hemolysin D [Sinorhizobium meliloti] | 90.9 | 596 | 34% | 3e-15 | 31% | WP_017265529.1 |
| calcium-binding protein [Caulobacter crescentus CB15] | 90.1 | 320 | 37% | 3e-15 | 31% | NP_421411.1 |
| iron-regulated protein FrpC [Caulobacter crescentus NA1000] | 90.1 | 257 | 37% | 3e-15 | 31% | YP_002518066.1 |
| Hemolysin-type calcium-binding repeat (2 copies) [Sinorhizobium meliloti GR4] | 90.5 | 417 | 32% | 4e-15 | 28% | YP_007195216.1 |
| hemolysin D, partial [Sinorhizobium meliloti] | 89.7 | 658 | 31% | 6e-15 | 31% | WP_017274029.1 |
| hypothetical protein [Methylobacterium sp. 77] | 89.4 | 89.4 | 31% | 8c-15 | 29% | WP_019906466.1 |
| hypothetical protein [Oscillatoria sp. PCC 10802] | 88.6 | 333 | 35% | 8e-15 | 32% | WP_017718625.1 |
| calcium binding hemolysin protein [Azospirillum sp. B510] | 89.4 | 894 | 30% | 1e-14 | 30% | YP_003450312.1 |
| hemolysin D [Sinorhizobium medicae] | 87.8 | 377 | 32% | 2e-14 | 28% | WP_018207839.1 |
| hemolysin-type calcium-binding protein, partial [Thalassospira xiamenensis] | 88.2 | 822 | 31% | 3c-14 | 36% | WP_007088891.1 |
| proprotein convertase P [Methylobacterium nodulans ORS 2060] | 86.7 | 210 | 29% | 4e-14 | 31% | YP_002495897.1 |
| hemolysin-type calcium-binding protein [Sinorhizobium meliloti BL225C] | 87.0 | 326 | 32% | 4e-14 | 28% | YP_005716684.1 |
| hypothetical protein AZOLI_p40606 [Azospirillum lipoferum 4B] | 87.4 | 812 | 37% | 5e-14 | 34% | YP_004975543.1 |
| hemolysin-type calcium-binding region [Polaromonas sp. JS666] | 86.7 | 531 | 29% | 6e-14 | 31% | YP_551701.1 |
| hypothetical protein RLDS_09615 [Sphingobium lactosutens DS20] | 86.3 | 86.3 | 33% | 6e-14 | 30% | EQB15964.1 |
| rhizobiocin/RTX toxin and hemolysin-type calcium binding protein [Tistrella mobilis KA081020-065] | 84.7 | 160 | 30% | 1e-13 | 32% | YP_006370736.1 |
| hemolysin D [Sinorhizobium medicae] | 85.5 | 421 | 32% | 1e-13 | 28% | WP_018009580.1 |
| Ca2+-binding protein, RTX toxin [Microvirga sp. WSM3557] | 85.1 | 316 | 34% | 2e-13 | 29% | WP_009490921.1 |

*FIG. 6B*

| Description | Max score | Total score | Query cover | E value | Ident | Accession No. |
|---|---|---|---|---|---|---|
| hemolysin D [Sinorhizobium meliloti] | 84.0 | 322 | 32% | 3e-13 | 28% | WP_017263229.1 |
| type I secretion target repeat-containing protein [Roseobacter denitrificans OCh 114] | 83.2 | 83.2 | 28% | 4e-13 | 29% | YP_681508.1 |
| protein of unknown function [Azospirillum brasilense Sp245] | 84.0 | 84.0 | 31% | 4e-13 | 29% | YP_005030312.1 |
| hemolysin-type calcium-binding region [Desulfovibrio salexigens DSM 2638] | 84.0 | 191 | 37% | 4e-13 | 29% | YP_002992972.1 |
| hypothetical protein [Sphingobium yanoikuyae] | 83.2 | 277 | 35% | 7e-13 | 30% | WP_004210915.1 |
| hypothetical protein [Brachymonas chironomi] | 82.4 | 150 | 34% | 7e-13 | 28% | WP_018716239.1 |
| Hemolysin-type calcium-binding region [Shewanella piezotolerans WP3] | 82.8 | 506 | 34% | 1e-12 | 33% | YP_002310757.1 |
| Hemolysin-type calcium-binding region [Rhodobacter sp. SW2] | 82.4 | 406 | 33% | 1e-12 | 31% | WP_008029683.1 |
| hemolysin-type calcium-binding region [Aeromonas media] | 81.6 | 239 | 30% | 1e-12 | 31% | WP_005332196.1 |
| Alkaline phosphatase [Micavibrio aeruginosavorus EPB] | 81.6 | 81.6 | 15% | 2e-12 | 37% | YP_007643803.1 |
| RTX toxins/related Ca2+-binding protein [Rubellimicrobium thermophilum DSM 16684] | 79.7 | 250 | 33% | 5e-12 | 32% | EPX86685.1 |
| type I secretion target GGXGXDXXX repeat protein [uncultured marine bacterium 582] | 80.5 | 420 | 36% | 5e-12 | 33% | AAR38409.1 |
| hemolysin-type calcium-binding repeat family protein, partial [uncultured bacterium] | 79.3 | 204 | 33% | 7e-12 | 30% | EKD61936.1 |
| hypothetical protein [Methylovulum miyakonense] | 79.3 | 120 | 30% | 8e-12 | 30% | WP_019867241.1 |
| hemolysin-type calcium-binding region, RTX, partial [Rhodobacter sphaeroides 2.4.1] | 78.6 | 172 | 31% | 1e-11 | 30% | YP_355041.1 |
| hypothetical protein [Massilia niastensis] | 79.0 | 314 | 37% | 1e-11 | 29% | WP_020655477.1 |
| hypothetical protein, partial [Magnetospirillum sp. SO-1] | 79.0 | 175 | 42% | 1e-11 | 28% | WP_008622436.1 |
| hypothetical protein [Methylovulum miyakonense] | 78.6 | 78.6 | 30% | 1e-11 | 32% | WP_019867066.1 |
| hypothetical protein [Methylobacterium sp. 77] | 78.2 | 142 | 29% | 2e-11 | 37% | WP_019903186.1 |
| calcium binding hemolysin protein [Tistrella mobilis KA081020-065] | 78.6 | 271 | 31% | 2e-11 | 37% | YP_006370737.1 |
| Alkaline phosphatase [Thalassobacter arenae DSM 19593] | 77.4 | 132 | 29% | 3e-11 | 27% | EPX78170.1 |
| RTX toxin exported protein RtxA [Cupriavidus necator N-1] | 77.8 | 126 | 15% | 4e-11 | 34% | YP_004680854.1 |
| hypothetical protein [Oscillatoria sp. PCC 10802] | 77.4 | 139 | 33% | 4e-11 | 30% | WP_020480612.1 |
| proprotein convertase P [Tistrella mobilis KA081020-065] | 77.0 | 143 | 30% | 4e-11 | 29% | YP_006370739.1 |
| hemolysin-type calcium-binding repeat protein [Leptolyngbya sp. PCC 7375] | 77.4 | 261 | 29% | 5e-11 | 33% | WP_006519062.1 |
| Hemolysin-type calcium-binding region [Rhodobacter sp. SW2] | 76.6 | 307 | 33% | 5e-11 | 31% | WP_008030394.1 |
| hypothetical protein [Sphingobium yanoikuyae] | 77.0 | 238 | 36% | 5e-11 | 29% | WP_004207719.1 |
| hemolysin-type calcium-binding protein [Starkeya novella DSM 506] | 76.6 | 251 | 34% | 6e-11 | 30% | YP_003693926.1 |
| hypothetical protein [Oscillatoria sp. PCC 10802] | 76.3 | 260 | 31% | 6e-11 | 31% | WP_017717249.1 |

FIG. 6C

| Description | Max score | Total score | Query cover | E value | Ident | Accession No. |
|---|---|---|---|---|---|---|
| 5'-nucleotidase domain-containing protein [Rhodopseudomonas palustris DX-1] | 77.0 | 120 | 32% | 6e-11 | 29% | YP_004110428.1 |
| calcium binding hemolysin protein [Tistrella mobilis KA081020-065] | 75.9 | 302 | 33% | 8e-11 | 30% | YP_006370049.1 |
| hypothetical protein [Aliivibrio logei] | 76.3 | 185 | 28% | 8e-11 | 32% | WP_017023581.1 |
| hemolysin-type calcium-binding region [Nitrosomonas sp. AL212] | 75.5 | 230 | 32% | 8e-11 | 28% | YP_004295065.1 |
| calcium binding hemolysin protein, putative [Bradyrhizobium oligotrophicum S58] | 76.3 | 343 | 39% | 1e-10 | 28% | YP_007512736.1 |
| Hemolysin-type calcium-binding protein [Agrobacterium vitis S4] | 75.9 | 242 | 28% | 1e-10 | 29% | YP_002548098.1 |
| hemolysin-adenylate cyclase [Phaeospirillum fulvum MGU-K5] | 75.9 | 172 | 37% | 1e-10 | 29% | EPY02797.1 |
| hemolysin-type calcium-binding protein [Desulfomicrobium baculatum DSM 4028] | 75.9 | 306 | 34% | 1e-10 | 30% | YP_003158921.1 |
| hypothetical protein [Pseudomonas alcaliphila] | 75.5 | 363 | 33% | 2e-10 | 30% | WP_017677435.1 |
| type I secretion protein [Vibrio sp. N418] | 75.1 | 261 | 28% | 2e-10 | 30% | WP_009385092.1 |
| hypothetical protein, partial [Endozoicomonas elysicola] | 75.1 | 249 | 29% | 2e-10 | 30% | WP_020583217.1 |
| hypothetical protein [Oscillatoria sp. PCC 10802] | 73.9 | 283 | 35% | 4e-10 | 28% | WP_017721018.1 |
| hemolysin-type calcium-binding protein [Desulfomicrobium baculatum DSM 4028] | 72.8 | 734 | 36% | 1e-09 | 27% | YP_003158384.1 |
| hypothetical protein [Methylobacterium sp. 77] | 72.4 | 292 | 37% | 1e-09 | 28% | WP_019903589.1 |
| hypothetical protein BJ6T_06520 [Bradyrhizobium japonicum USDA 6] | 71.2 | 71.2 | 29% | 2e-09 | 32% | YP_005605535.1 |

FIG. 6D

| Description | Max score | Total score | Query cover | E value | Ident | Accession No. |
|---|---|---|---|---|---|---|
| hypothetical protein amb3422 [Magnetospirillum magneticum AMB-1] | 1830 | 1925 | 100% | 0.0 | 100% | YP_422785.1 |
| hypothetical protein [Magnetospirillum sp. SO-1] > | 1082 | 1211 | 100% | 0.0 | 64% | WP_008614612.1 |
| COG2931: RTX toxins and related Ca2+-binding proteins [Magnetospirillum magnetotacticum] | 688 | 1045 | 98% | 0.0 | 58% | WP_009870351.1 |
| hypothetical protein K678_05578 [Phaeospirillum fulvum MGU5] | 272 | 272 | 48% | 1e-75 | 41% | EPY02541.1 |
| HEMAGGLUTININ/HEMOLYSIN-RELATED PROTEIN [Magnetospirillum gryphiswaldense MSR-1] | 126 | 249 | 74% | 3e-26 | 30% | CAM76811.1 |
| outer membrane adhesin like protein, partial [Achromobacter piechaudii] | 88.2 | 880 | 34% | 2e-14 | 32% | WP_006216951.1 |
| VCBS repeat-containing protein [Solitalea canadensis DSM 3403] | 87.0 | 806 | 33% | 3e-14 | 34% | YP_006254384.1 |
| hypothetical protein, partial [Pedobacter agri] | 85.9 | 125 | 34% | 8c-14 | 29% | WP_010602925.1 |
| hypothetical protein AM1_E0108 [Acaryochloris marina MBIC11017] | 82.8 | 82.8 | 28% | 7e-13 | 34% | YP_001522191.1 |
| putative hemolysin [Cellvibrio japonicus Ueda107] | 82.0 | 505 | 34% | 1e-12 | 31% | YP_001981885.1 |
| outer membrane adhesin-like protein [Pseudomonas denitrificans ATCC 13867] | 75.5 | 321 | 36% | 1e-10 | 30% | YP_007656731.1 |
| hypothetical protein Plut_0379 [Chlorobium luteolum DSM 273] | 75.5 | 134 | 28% | 1e-10 | 30% | YP_374310.1 |
| hypothetical protein [Rhizobium sp. 2MFCol3.1] | 72.8 | 1046 | 40% | 9e-10 | 32% | WP_018896697.1 |
| hemagglutinin/hemolysin-like protein [Dickeya dadantii 3937] | 67.0 | 450 | 27% | 4e-08 | 31% | YP_003881756.1 |
| hypothetical protein [Novispirillum itersonii] | 67.0 | 122 | 35% | 5e-08 | 28% | WP_019646374.1 |
| rhizobiocin RzcA [Asticcacaulis biprosthecium] | 66.6 | 66.6 | 11% | 7e-08 | 40% | WP_006274635.1 |
| outer membrane adhesin-like protein [Chitinophaga pinensis DSM 2588] | 66.2 | 458 | 31% | 7e-08 | 29% | YP_003125000.1 |
| uncharacterized protein [uncultured bacterium] | 60.8 | 107 | 28% | 4e-06 | 31% | CAX84233.1 |
| outer membrane adhesin-like protein [Cyanothece sp. PCC 7822] | 59.3 | 117 | 24% | 1c-05 | 30% | YP_003890797.1 |
| hypothetical protein [Methyloversatilis universalis] | 57.8 | 103 | 37% | 3e-05 | 29% | WP_018230537.1 |
| Large exoprotein [Roseovarius sp. TM1035] | 53.5 | 140 | 25% | 6e-04 | 28% | WP_008281368.1 |
| outer membrane autotransporter barrel domain protein [Methylobacterium sp. GXF4] | 50.4 | 50.4 | 33% | 0.005 | 27% | WP_007560973.1 |
| cadherin [Rhodopirellula baltica] | 50.1 | 50.1 | 14% | 0.007 | 32% | WP_007329466.1 |
| outer membrane transport barrel [Sphingomonas sp. MM-1] | 49.3 | 49.3 | 29% | 0.012 | 28% | YP_007614514.1 |
| hypothetical protein [Methyloversatilis universalis] | 46.2 | 46.2 | 37% | 0.099 | 30% | WP_008064234.1 |
| hypothetical protein AZL_f01290 [Azospirillum sp. B510] | 45.8 | 45.8 | 9% | 0.13 | 39% | YP_003453433.1 |
| outer membrane autotransporter [Burkholderia ambifaria MC40-6] | 44.3 | 44.3 | 35% | 0.36 | 29% | YP_001816158.1 |
| hemolysin-type calcium-binding region [Nostoc punctiforme PCC 73102] | 41.6 | 41.6 | 23% | 2.5 | 27% | YP_001867978.1 |
| transporter [Pseudomonas chlororaphis] | 41.2 | 41.2 | 12% | 3.2 | 35% | WP_009043135.1 |
| hypothetical protein [Bradyrhizobium sp. WSM471] | 40.0 | 40.0 | 16% | 6.8 | 29% | WP_007605159.1 |

*FIG. 7*

| Description | Max score | Total score | Query cover | E value | Ident | Accession No. |
|---|---|---|---|---|---|---|
| ABC-type protease/lipase transport system, ATPase and permease components [Magnetospirillum magneticum AMB-1] | 1220 | 1220 | 100% | 0.0 | 100% | YP_422838.1 |
| COG2274: ABC-type bacteriocin/lantibiotic exporters, contain an N-terminal double-glycine peptidase domain [Magnetospirillum magnetotacticum] | 1090 | 1090 | 93% | 0.0 | 95% | WP_009870208.1 |
| ABC-type protease/lipase transport system, ATPase and permease component protein [Magnetospirillum sp. SO-1] | 1076 | 1076 | 98% | 0.0 | 91% | WP_008619118.1 |
| ABC-type protease/lipase transport system, ATPase and permease component [Phaeospirillum fulvum MGU-K5] | 896 | 896 | 93% | 0.0 | 79% | EPY00949.1 |
| hypothetical protein [Novispirillum itersonii] | 611 | 611 | 91% | 0.0 | 56% | WP_019643622.1 |
| ABC-type protease/lipase transporter [Caenispirillum salinarum] | 592 | 592 | 94% | 0.0 | 54% | WP_009539978.1 |
| ABC-type protease/lipase transport system,ATPase and permease components [Rhodospirillum photometricum DSM 122] | 581 | 581 | 92% | 0.0 | 55% | YP_005416034.1 |
| protein containing ABC transporter domain [Magnetospirillum gryphiswaldense MSR-1] | 525 | 525 | 59% | 9e-180 | 70% | CAM77380.1 |
| ABC-type protease/lipase transport system, ATPase and permease components [Glaciecola sp. HTCC2999] | 449 | 449 | 91% | 1e-146 | 39% | WP_010180038.1 |
| ABC-type protease/lipase transport system, ATPase and permease components [Limnobacter sp. MED105] | 448 | 448 | 95% | 7e-146 | 39% | WP_008248572.1 |
| ABC-type protease/lipase transport system [Pseudomonas stutzeri] | 439 | 439 | 93% | 4e-143 | 42% | WP_003293555.1 |
| ABC transporter related protein [Osedax symbiont Rs1] | 351 | 351 | 90% | 6e-108 | 36% | WP_019813773.1 |
| ABC transporter ATP-binding/permease protein [Thauera sp. 28] | 350 | 350 | 92% | 4e-107 | 37% | WP_002931922.1 |
| ABC transporter ATP-binding/permease protein [Thauera sp. 27] | 350 | 350 | 92% | 5e-107 | 37% | WP_002944457.1 |
| hypothetical protein [Thioalkalivibrio sp. ALgr5] | 345 | 345 | 92% | 8e-107 | 35% | WP_019592978.1 |
| hypothetical protein [Thioalkalivibrio sp. ALE27] | 343 | 343 | 92% | 3e-106 | 35% | WP_018882170.1 |
| ABC transporter [Thioalkalivibrio sp. ALE25] | 345 | 345 | 92% | 4e-106 | 35% | WP_018867039.1 |
| ABC transporter [Thioalkalivibrio sp. AKL3] | 346 | 346 | 92% | 6e-106 | 35% | WP_018937733.1 |
| ABC transporter [Azoarcus toluclasticus] | 346 | 346 | 92% | 9e-106 | 37% | WP_018987943.1 |
| type I secretion system ATPase [Desulfomicrobium baculatum DSM 4028] | 346 | 346 | 94% | 1e-105 | 35% | YP_003158388.1 |
| ABC transporter [Thioalkalivibrio sp. ALMg2] | 345 | 345 | 92% | 1e-105 | 35% | WP_019563530.1 |
| toxin secretion ABC transporter permease and ATP-binding protein [Azoarcus sp. KH32C] | 345 | 345 | 92% | 1e-105 | 38% | YP_007553126.1 |
| ABC transporter [Thioalkalivibrio sp. ALE28] | 343 | 343 | 92% | 2e-105 | 35% | WP_018877499.1 |

*FIG. 8A*

| Description | Max score | Total score | Query cover | E value | Ident | Accession No. |
|---|---|---|---|---|---|---|
| ABC-type bacteriocin/lantibiotic exporter [Vibrio fluvialis] | 344 | 344 | 91% | 3e-105 | 32% | WP_020331854.1 |
| ABC transporter [Thioalkalivibrio sp. ALM2T] | 344 | 344 | 92% | 5e-105 | 35% | WP_019594102.1 |
| ABC transporter [Thioalkalivibrio sp. ALMg13-2] | 344 | 344 | 92% | 5e-105 | 35% | WP_019568356.1 |
| ABC transporter [Thioalkalivibrio sp. AKL12] | 344 | 344 | 92% | 5e-105 | 35% | WP_018951739.1 |
| ABC transporter related protein [Osedax symbiont Rs2] | 343 | 343 | 93% | 6e-105 | 34% | WP_020286188.1 |
| ABC transporter [Thioalkalivibrio sp. AKL10] | 343 | 343 | 92% | 6e-105 | 35% | WP_019628234.1 |
| ABC transporter [Thioalkalivibrio sp. ALJ3] | 343 | 343 | 92% | 7e-105 | 36% | WP_018861453.1 |
| ABC transporter [Thioalkalivibrio sp. ALJ16] | 343 | 343 | 92% | 9e-105 | 36% | WP_018873589.1 |
| ABC transporter [Neptuniibacter caesariensis] | 342 | 342 | 91% | 3e-104 | 35% | WP_007022486.1 |
| ATPase [Halomonas sp. GFAJ-1] | 342 | 342 | 93% | 3e-104 | 35% | WP_009100771.1 |
| ABC transporter, transmembrane region::ABC transporter::Peptidase C39, bacteriocin processing [Methylophaga sp. JAM7] > | 342 | 342 | 91% | 4e-104 | 34% | YP_006292562.1 |
| ABC transporter [Thioalkalivibrio sp. ALJ10] | 342 | 342 | 92% | 4e-104 | 35% | WP_018868670.1 |
| ABC transporter [Thioalkalivibrio sp. ALJT] | 340 | 340 | 92% | 8e-104 | 36% | WP_019626728.1 |
| ABC transporter [Thioalkalivibrio sp. AKL11] | 341 | 341 | 92% | 1e-103 | 35% | WP_018939823.1 |
| type I secretion system ATPase [Sulfurospirillum deleyianum DSM 6946] | 340 | 340 | 93% | 2e-103 | 34% | YP_003303859.1 |
| ABC transporter [Methylophaga sp. JAM1] | 340 | 340 | 91% | 2e-103 | 35% | YP_006295629.1 |
| ABC transporter [Thioalkalivibrio sp. ARh5] | 338 | 338 | 92% | 7e-103 | 35% | WP_019624185.1 |
| ABC transporter [Thioalkalivibrio sp. ALJ20] | 338 | 338 | 92% | 9e-103 | 35% | WP_019024347.1 |
| ABC transporter [Campylobacter rectus] | 338 | 338 | 92% | 9c-103 | 34% | WP_004318584.1 |
| ABC transporter [Comamonas testosteroni] | 338 | 338 | 93% | 1e-102 | 34% | WP_003669985.1 |
| ABC transporter [Thioalkalivibrio sp. ALE20] | 337 | 337 | 92% | 2e-102 | 35% | WP_019592005.1 |
| ABC transporter [Thioalkalivibrio sp. ARh3] | 338 | 338 | 92% | 2e-102 | 35% | WP_018863861.1 |
| peptidase C39 [Rheinheimera nanhaiensis] | 337 | 337 | 91% | 3e-102 | 33% | WP_008220329.1 |
| ABC transporter [Thioalkalivibrio sp. HL-Eb18] | 336 | 336 | 92% | 5e-102 | 35% | WP_017926137.1 |
| ABC transporter [Comamonas testosteroni] | 337 | 337 | 93% | 5e-102 | 34% | WP_003075146.1 |
| ABC transporter ATP-binding protein [Marinobacter hydrocarbonoclasticus ATCC 49840] | 336 | 336 | 91% | 5e-102 | 35% | YP_005431238.1 |
| ABC transporter [Thioalkalivibrio sp. ALE10] | 335 | 335 | 92% | 7e-102 | 35% | WP_019590480.1 |
| ATPase [Halomonas sp. TD01] | 335 | 335 | 90% | 7e-102 | 35% | WP_009724196.1 |
| ABC transporter [Variovorax paradoxus EPS] | 332 | 332 | 92% | 9e-102 | 36% | YP_004157431.1 |
| ABC transporter [Thioalkalivibrio sp. ALJ11] | 335 | 335 | 92% | 1e-101 | 35% | WP_018139367.1 |

FIG. 8B

| Description | Max score | Total score | Query cover | E value | Ident | Accession No. |
|---|---|---|---|---|---|---|
| ATPase [Halomonas stevensii] | 335 | 335 | 90% | 1e-101 | 35% | WP_016915006.1 |
| type I secretion system ATPase [Thioalkalivibrio sp. K90mix] | 335 | 335 | 92% | 2e-101 | 35% | YP_003460560.1 |
| ABC transporter [Thioalkalivibrio sp. ALRh] | 335 | 335 | 92% | 2e-101 | 35% | WP_019592545.1 |
| toxin secretion ATP-binding protein [Comamonas testosteroni CNB-2] | 335 | 335 | 93% | 2e-101 | 34% | YP_003279062.1 |
| ABC transporter [Thioalkalivibrio thiocyanodenitrificans] | 335 | 335 | 92% | 2e-101 | 35% | WP_018233111.1 |
| hypothetical protein [Catenovulum agarivorans] | 333 | 333 | 90% | 4e-101 | 36% | WP_016954151.1 |
| ABC transporter [Thioalkalivibrio sp. ALgr1] | 333 | 333 | 92% | 6e-101 | 35% | WP_018993876.1 |
| ABC transporter ATP-binding component [Arcobacter sp. L] | 333 | 333 | 90% | 8e-101 | 34% | YP_005552492.1 |
| ABC transporter [Pseudoalteromonas arctica] | 332 | 332 | 91% | 1e-100 | 34% | WP_010553238.1 |
| ABC transporter [Pseudoalteromonas sp. BSi20429] | 331 | 331 | 91% | 4e-100 | 34% | WP_007583161.1 |
| ABC transporter [Campylobacter curvus] | 331 | 331 | 92% | 4e-100 | 33% | WP_018136203.1 |
| ABC transporter [Campylobacter sp. FOBRC14] | 331 | 331 | 92% | 5e-100 | 33% | WP_009650523.1 |
| ABC transporter [Comamonas testosteroni] | 330 | 330 | 93% | 5e-100 | 34% | WP_003053581.1 |
| ABC transporter [Campylobacter sp. 10_1_50] | 330 | 330 | 91% | 6e-100 | 34% | WP_009294535.1 |
| ABC transporter [gamma proteobacterium IMCC1989] | 332 | 332 | 92% | 6e-100 | 34% | WP_009670226.1 |
| hypothetical protein CCC13826_0891 [Campylobacter concisus 13826] | 330 | 330 | 91% | 7e-100 | 34% | YP_001466532.1 |
| bacteriocin/lantibiotic ABC transporter [Hahella chejuensis KCTC 2396] | 331 | 331 | 91% | 9e-100 | 33% | YP_437190.1 |
| toxin secretion ATP-binding protein [Campylobacter curvus 525.92] | 330 | 330 | 92% | 1e-99 | 33% | YP_001408654.1 |
| ABC transporter [Comamonas testosteroni] | 331 | 331 | 93% | 1e-99 | 34% | WP_019043539.1 |
| ABC transporter [Variovorax sp. CF313] | 326 | 326 | 90% | 2e-99 | 37% | WP_007838295.1 |
| hypothetical protein [Succinispira mobilis] | 330 | 330 | 91% | 2e-99 | 34% | WP_019878733.1 |
| ABC transporter [Pseudoalteromonas haloplanktis] | 329 | 329 | 91% | 2e-99 | 33% | WP_002961326.1 |
| ABC transporter permease/ATP-binding protein [Xanthomonas fragariae] | 329 | 329 | 95% | 2e-99 | 35% | WP_002804835.1 |
| ABC transporter permease/ATP-binding protein [Xanthomonas axonopodis] | 328 | 328 | 95% | 3e-99 | 35% | WP_005913568.1 |
| peptidase C39 [Methylophaga aminisulfidivorans] | 329 | 329 | 89% | 3e-99 | 34% | WP_007145632.1 |
| ABC transporter [Achromobacter arsenitoxydans] | 328 | 328 | 91% | 4e-99 | 33% | WP_008164875.1 |
| peptidase C39 [Xanthomonas arboricola] | 328 | 328 | 95% | 4e-99 | 35% | WP_016902305.1 |
| peptidase C39 [Xanthomonas fuscans] | 328 | 328 | 95% | 4e-99 | 35% | WP_007972241.1 |
| peptidase C39 [Xanthomonas gardneri] | 328 | 328 | 95% | 4e-99 | 34% | WP_006449299.1 |
| toxin secretion ABC transporter permease and ATP-binding protein [Thauera linaloolentis] | 328 | 328 | 91% | 7e-99 | 36% | WP_004332497.1 |
| ABC transporter [Variovorax paradoxus S110] | 325 | 325 | 91% | 8e-99 | 35% | YP_002946334.1 |

*FIG. 8C*

| Description | Max score | Total score | Query cover | E value | Ident | Accession No. |
|---|---|---|---|---|---|---|
| ABC transporter [Alcaligenes faecalis] | 327 | 327 | 91% | 8e-99 | 34% | WP_003802991.1 |
| ABC transporter [Vibrio alginolyticus] | 327 | 327 | 92% | 9e-99 | 34% | WP_005374556.1 |
| ABC transporter [Burkholderia ubonensis] | 328 | 328 | 91% | 9e-99 | 34% | WP_010089615.1 |
| ABC transporter permease/ATP-binding protein [Xanthomonas axonopodis pv. citrumelo F1] | 327 | 327 | 95% | 1e-98 | 35% | YP_004852936.1 |
| ABC transporter [Vibrio sp. 712i1] | 327 | 327 | 92% | 1e-98 | 34% | WP_017634537.1 |
| ABC transporter [Vibrio alginolyticus] | 327 | 327 | 92% | 2e-98 | 34% | WP_005383569.1 |
| type I secretion system ATPase [Leptothrix cholodnii SP-6] | 327 | 327 | 91% | 2e-98 | 35% | YP_001791124.1 |
| ABC transporter [Variovorax paradoxus] | 323 | 323 | 91% | 2e-98 | 35% | WP_019906841.1 |
| ABC transporter [Vibrio sinaloensis] | 326 | 326 | 92% | 2e-98 | 34% | WP_008074445.1 |
| ABC transporter [Halomonas sp. KM-1] | 327 | 327 | 91% | 2e-98 | 36% | WP_010628832.1 |
| type I secretion system AtPase HlyB [Candidatus Nitrospira defluvii] | 326 | 326 | 91% | 3e-98 | 33% | YP_003799068.1 |
| ABC transporter [Marinobacterium stanieri] | 326 | 326 | 91% | 3e-98 | 35% | WP_010325122.1 |
| peptidase C39 [Arhodomonas aquaeolei] | 325 | 325 | 90% | 3e-98 | 34% | WP_018719059.1 |
| ABC transporter ATP-binding/permease [Aromatoleum aromaticum EbN1] | 327 | 327 | 92% | 3e-98 | 37% | YP_158002.1 |
| ABC transporter [Pectobacterium wasabiae] | 327 | 327 | 90% | 3e-98 | 35% | WP_005973599.1 |
| type I secretion system ATPase, partial [Candidatus Nitrosopumilus salaria] | 322 | 322 | 92% | 3e-98 | 33% | WP_008297682.1 |

*FIG. 8D*

| Description | Max score | Total score | Query cover | E value | Ident | Accession No. |
|---|---|---|---|---|---|---|
| Autotransporter adhesin [Magnetospirillum gryphiswaldense MSR-1] | 46.6 | 78.6 | 19% | 1e-05 | 40% | CAM74531.1 |
| RTX toxins and related Ca2+-binding protein [Magnetospirillum magneticum AMB-1] | 45.1 | 105 | 13% | 4e-05 | 45% | YP_420640.1 |
| COG5295: Autotransporter adhesin [Magnetospirillum magnetotacticum] | 44.7 | 105 | 15% | 7e-05 | 46% | WP_009869454.1 |
| hypothetical protein, partial [Magnetospirillum sp. SO-1] > | 43.9 | 132 | 19% | 1e-04 | 37% | WP_008622436.1 |
| COG2931: RTX toxins and related Ca2+-binding proteins [Magnetospirillum magnetotacticum] | 43.9 | 174 | 32% | 1e-04 | 42% | WP_009869271.1 |
| hypothetical protein amb3422 [Magnetospirillum magneticum AMB-1] | 43.5 | 192 | 46% | 1e-04 | 39% | YP_422785.1 |
| Type V secretory pathway, adhesin AidA [Magnetospirillum magneticum AMB-1] | 41.6 | 183 | 15% | 6e-04 | 36% | YP_421364.1 |
| COG2931: RTX toxins and related Ca2+-binding proteins [Magnetospirillum magnetotacticum] | 41.6 | 288 | 13% | 6e-04 | 44% | WP_009868027.1 |
| large exoprotein [Magnetospirillum magneticum AMB-1] | 40.8 | 115 | 11% | 0.001 | 44% | YP_420631.1 |
| COG2931: RTX toxins and related Ca2+-binding proteins [Magnetospirillum magnetotacticum] | 39.7 | 107 | 15% | 0.003 | 47% | YP_423419.1 |
| RTX toxin [Magnetospirillum sp. SO-1] | 37.7 | 133 | 19% | 0.008 | 29% | WP_008615895.1 |
| Hemolysin-type calcium-binding region [Magnetospirillum gryphiswaldense MSR-1] | 37.0 | 196 | 42% | 0.014 | 30% | CAM77170.1 |
| hypothetical protein [Magnetospirillum sp. SO-1] | 37.0 | 404 | 23% | 0.019 | 36% | WP_008614612.1 |
| Type V secretory pathway [Magnetospirillum magneticum AMB-1] | 36.6 | 36.6 | 6% | 0.019 | 52% | YP_420638.1 |
| COG2931: RTX toxins and related Ca2+-binding proteins [Magnetospirillum magnetotacticum] | 36.2 | 70.5 | 16% | 0.026 | 33% | WP_009868207.1 |
| VBCS repeat-containing protein, partial [Magnetospirillum sp. SO-1] | 35.4 | 35.4 | 11% | 0.042 | 40% | WP_008621158.1 |
| RTX toxins and related Ca2+-binding protein [Magnetospirillum magneticum AMB-1] | 35.4 | 63.1 | 10% | 0.045 | 45% | YP_422662.1 |
| outer membrane adhesin-like protein, partial [Magnetospirillum sp. SO-1] | 35.4 | 35.4 | 13% | 0.049 | 35% | WP_008622382.1 |
| hemolysin-type calcium-binding repeat-containing protein, partial [Magnetospirillum sp. SO-1] | 35.4 | 125 | 22% | 0.051 | 33% | WP_008617421.1 |
| COG2931: RTX toxins and related Ca2+-binding proteins [Magnetospirillum magnetotacticum] | 34.3 | 34.3 | 9% | 0.054 | 38% | WP_009865035.1 |
| COG2931: RTX toxins and related Ca2+-binding proteins [Magnetospirillum magnetotacticum] | 33.9 | 33.9 | 14% | 0.064 | 32% | WP_009864918.1 |
| Autotransporter adhesin [Magnetospirillum gryphiswaldense MSR-1] | 34.3 | 324 | 16% | 0.12 | 47% | CAM76579.1 |

*FIG. 9A*

| Description | Max score | Total score | Query cover | E value | Ident | Accession No. |
|---|---|---|---|---|---|---|
| COG2931: RTX toxins and related Ca2+-binding proteins, partial [Magnetospirillum magnetotacticum] | 33.1 | 97.4 | 13% | 0.15 | 43% | WP_009865796.1 |
| COG2931: RTX toxins and related Ca2+-binding proteins [Magnetospirillum magnetotacticum] | 33.9 | 158 | 13% | 0.16 | 32% | WP_009870351.1 |
| Type V secretory pathway, adhesin AidA, partial [Magnetospirillum sp. SO-1] | 33.1 | 33.1 | 11% | 0.22 | 35% | WP_008619475.1 |
| hypothetical protein, partial [Magnetospirillum sp. SO-1] | 32.0 | 90.5 | 14% | 0.36 | 32% | WP_008622842.1 |
| Holliday junction DNA helicase RuvB [Magnetospirillum magneticum AMB-1] | 31.6 | 31.6 | 7% | 0.61 | 47% | YP_422579.1 |
| COG2931: RTX toxins and related Ca2+-binding proteins, partial [Magnetospirillum magnetotacticum] | 31.6 | 119 | 13% | 0.62 | 49% | WP_009865379.1 |
| Holliday junction DNA helicase RuvB [Magnetospirillum sp. SO-1] | 31.2 | 31.2 | 7% | 0.66 | 47% | WP_008621034.1 |
| COG2931: RTX toxins and related Ca2+-binding proteins, partial [Magnetospirillum magnetotacticum] | 31.2 | 60.1 | 22% | 0.70 | 26% | WP_009863686.1 |
| COG2931: RTX toxins and related Ca2+-binding proteins [Magnetospirillum magnetotacticum] | 31.2 | 60.4 | 24% | 0.81 | 31% | WP_009865975.1 |
| COG2931: RTX toxins and related Ca2+-binding proteins [Magnetospirillum magnetotacticum] | 31.2 | 150 | 18% | 0.83 | 45% | WP_009865835.1 |
| hypothetical protein, partial [Magnetospirillum sp. SO-1] | 30.4 | 57.8 | 18% | 0.90 | 39% | WP_008622434.1 |
| COG4953: Membrane carboxypeptidase/penicillin-binding protein PbpC, partial [Magnetospirillum magnetotacticum] | 30.8 | 30.8 | 16% | 1.0 | 31% | WP_009868232.1 |
| COG2931: RTX toxins and related Ca2+-binding proteins, partial [Magnetospirillum magnetotacticum] | 30.4 | 59.7 | 21% | 1.1 | 28% | WP_009862535.1 |
| RTX toxins and related Ca2+-binding proteins [Magnetospirillum gryphiswaldense MSR-1] | 30.8 | 30.8 | 8% | 1.3 | 34% | CAM75368.1 |
| calcium binding hemolysin protein, partial [Magnetospirillum sp. SO-1] | 29.3 | 85.9 | 11% | 2.2 | 31% | WP_008615635.1 |
| COG2931: RTX toxins and related Ca2+-binding proteins, partial [Magnetospirillum magnetotacticum] | 28.5 | 28.5 | 8% | 3.2 | 35% | WP_009861891.1 |
| COG2931: RTX toxins and related Ca2+-binding proteins, partial [Magnetospirillum magnetotacticum] | 29.3 | 57.4 | 13% | 3.3 | 40% | WP_009865727.1 |
| lipoprotein releasing system ATP-binding protein [Magnetospirillum gryphiswaldense MSR-1] | 28.1 | 28.1 | 7% | 5.5 | 37% | CAM74983.1 |
| hypothetical protein MGR_1109 [Magnetospirillum gryphiswaldense MSR-1] | 28.5 | 28.5 | 19% | 6.1 | 31% | CAM76862.1 |
| COG0265: Trypsin-like serine proteases, typically periplasmic, contain C-terminal | 28.1 | 28.1 | 6% | 6.3 | 37% | WP_009865351.1 |

*FIG. 9B*

| Description | Max score | Total score | Query cover | E value | Ident | Accession No. |
|---|---|---|---|---|---|---|
| PDZ domain, partial [Magnetospirillum magnetotacticum] | | | | | | |
| COG1680: Beta-lactamase class C and other penicillin binding proteins [Magnetospirillum magnetotacticum] | 28.1 | 28.1 | 7% | 6.9 | 42% | WP_009870006.1 |
| COG2931: RTX toxins and related Ca2+-binding proteins [Magnetospirillum magnetotacticum] | 26.2 | 26.2 | 5% | 6.9 | 50% | WP_009862419.1 |
| asparagine synthase [Magnetospirillum sp. SO-1] >gb|EME69335.1: asparagine synthase [Magnetospirillum sp. SO-1] | 28.1 | 28.1 | 14% | 7.8 | 28% | WP_008618626.1 |

FIG. 9C

HOST CELL MODIFICATION WITH ARTIFICIAL ENDOSYMBIONTS

CROSS REFERENCE TO RELATED APPLICATIONS

This application claims benefit of U.S. Provisional application Ser. No. 61/873,308, filed Sep. 3, 2013, the contents of which are incorporated herein by reference.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "BELL.018_ST25.txt", a creation date of Sep. 3, 2014, and a size of 962 kilobytes. The Sequence Listing filed via EFS-Web is part of the specification and is hereby incorporated in its entirety by reference herein.

TECHNICAL FIELD

The present invention relates generally to host cells with artificial endosymbionts. The artificial endosymbionts of the host cell communicates with the host cell and changes aspects of the host cell.

BACKGROUND

The advent of recombinant DNA technology created the ability to alter the genetic makeup of organisms, eliminating the natural barriers that prevented transmission of genetic material between unrelated organisms. The ease of growing and manipulating bacteria and the numerous techniques available for introducing heterologous genes makes bacteria model organisms for genetic manipulation using recombinant DNA technology. Gram-negative and Gram-positive bacteria have been subjected to successful manipulation with recombinant DNA technology. Because of the well developed technology for transforming bacterial cells, the relative ease of genetically manipulating different bacteria, short reproduction times, and the comparatively small genomes, bacteria have been used as vehicles for synthetic biology applications, which aims to create novel artificial biological pathways, organisms or devices, or the redesign of existing natural biological systems. Moreover, bacteria exist with a wide range of functionalities, such as unique metabolic pathways (e.g., photo- and chemoautotrophism), magnetotactic properties (Blakemore, R., "Magnetotactic bacteria," *Science* 24: 377-379, 1975), and extremophiles (e.g., thermophiles), which allows creation of recombinant bacteria with the properties present in the bacterial host cell.

Recombinant DNA techniques have also been used to manipulate the genetic makeup of eukaryotic cells, transiently or as a heritable property. For example, homologous and targeted recombination allows the generation of recombinant animals containing heterologous genes. Despite the advances in technology, manipulation of eukaryotic cells by recombinant DNA techniques has greater challenges as compared to manipulation of bacteria. Some eukaryotic cells targeted for recombinant DNA manipulation, e.g., mammalian cells, are slower to grow than bacterial cells, making selection of eukaryotic cells containing a heterologous nucleic acid more time consuming. Creation of eukaryotic cells containing longer lasting changes, including heritable changes, typically requires the use of homologous recombination, which despite the advances in technology, continue to have low efficiency rates. In addition, introduction of multiple, different heterologous nucleic acids is complicated by the higher complexity of eukaryotic cells (e.g., presence of organelles), greater degree of unpredictability in responses to multiple heterologous factors, and the technological disadvantages of selecting eukaryotic cells having multiple genetic/phenotypic changes. Thus, it is desirable to find alternative methods of engineering eukaryotic cells for introducing new functionalities into the cells, where the methods can be applied independently of or in combination with recombinant DNA technology for modifying eukaryotic cells.

SUMMARY

The present invention is related to host cells that have been altered or reprogrammed by communication and/or transfer of chemical information with artificial endosymbionts. In some embodiments, the artificial endosymbionts of the invention secrete to and/or transport from the host cell polypeptides, nucleic acids, lipids, carbohydrates, amino acids, or other factors. In some embodiments, the artificial endosymbiont secretes a protein into the host cell. In some embodiments, the secreted protein is a heterologous protein to the artificial endosymbiont. In some embodiments, the secreted protein from the artificial endosymbiont causes a phenotype in the host cell. In some embodiments, the artificial endosymbiont of the invention secretes a nucleic acid into the host cell. In some embodiments, the nucleic acid s a recombinant nucleic acid. In some embodiments, the nucleic acid secreted from the artificial endosymbiont causes a phenotype in the host cell.

The invention also relates to methods for changing a host cell by the introduction of an artificial endosymbiont that secretes to and/or transports from the host cell polypeptides, nucleic acids, lipids, carbohydrates, amino acids, or other factors. In some embodiments, the method introduces a protein into the host cell from the artificial endosymbiont. In some embodiments, the method introduces a nucleic acid into the host cell from the artificial endosymbiont. In some embodiments, the method produces a phenotype in the host cell resulting from the polypeptide and/or nucleic acid introduced from the artificial endosymbiont.

In some embodiments, the host cells and methods of the invention are used to make medically and industrially important recombinant peptides/proteins that will be useful for therapeutic, biopharmaceutical, agricultural, and industrial applications. In some embodiments, the artificial endosymbionts and methods of the invention are used to introduce into host cells phenotypes that require the introduction of multiple factors and/or multiple genes.

In some embodiments, the host cell is a mammalian cell. In some embodiments, the host cell is a human, mouse, rat, canine, primate, or rodent cell. In some embodiments, the host cell is a fibroblast cell, epithelial cell, keratinocyte, hepatocyte, adipocyte or endothelial cell. In some embodiments, the host cell is a stem cell, or pluripotent ES cell, or pluripotent iPS cell, a multipotent mesenchymal stem cell or multipotent hematopoietic stem cell. In some embodiments, the host cell is a progenitor cell, such as for example, a neural progenitor cell, an angioblast, an osteoblast, a chondroblast, a pancreatic progenitor cell, or an epidermal progenitor cell. In some embodiments, the host cell is a solid tumor cell or a hematopoietic cancer cell. In some embodiments, the host cell is from a carcinoma, sarcoma, leukemia, lymphoma, or glioma. In some embodiments, the host cell is obtained from a prostate cancer, breast cancer, lung cancer, colorectal cancer, pancreatic cancer, melanoma, glioblastoma, liver cancer, or the NCI 60 panel of cancer cell lines.

BRIEF DESCRIPTION OF THE FIGURES

FIGS. 1A-1D depict BLAST results for a search with the amino acid sequence for Type V secretory pathway adhesin AidA (SEQ ID NO:1) from *Magnetospirillum magneticum* AMB-1. Exemplary sequences of homologous regions retrieved in the search, which included the search query *Magnetospirillum magneticum* AMB-1 adhesin AidA, are presented as SEQ ID NOS:1-103.

FIGS. 2A-2D depict BLAST results for a search with the amino acid sequence for protein accession no. YP_420640, annotated as RTX toxin from *Magnetospirillum magneticum* AMB-1 (SEQ ID NO:104). Exemplary sequences of homologous regions retrieved in the search, which included the search query *Magnetospirillum magneticum* AMB-1 RTX toxin YP_420640, are presented as SEQ ID NOS:104-122.

FIGS. 3A-3D depict BLAST results for a search with the amino acid sequence for protein accession no. YP_423419, annotated as RTX toxin from *Magnetospirillum magneticum* AMB-1 (SEQ ID NO:123). Exemplary sequences containing homologous regions retrieved in the search, which included the search query *Magnetospirillum magneticum* AMB-1 RTX toxin YP_423419, are presented as SEQ ID NOS:123-129.

FIGS. 4A-4D depict BLAST results for a search with the amino acid sequence for large exoprotein from *Magnetospirillum magneticum* AMB-1 (SEQ ID NO:130).

FIGS. 5A-5D depict BLAST results for a search with the amino acid sequence for Type V secretory pathway protein (accession no. YP_420638) (SEQ ID NO:131) from *Magnetospirillum magneticum* AMB-1.

FIGS. 6A-6D depict BLAST results for a search with the amino acid sequence for protein accession no. YP_422662 (SEQ ID NO:132), annotated as RTX toxin from *Magnetospirillum magneticum* AMB-1. Exemplary sequences of homologous regions retrieved in the search, which included the search query *Magnetospirillum magneticum* AMB-1 RTX toxin YP_422662, are presented as SEQ ID NOS:132-140.

FIG. 7 depicts BLAST results for a search with the 949 C-terminal amino acids of YP 422785 (SEQ ID NO: 141) from *Magnetospirillum magneticum* AMB-1. Exemplary sequences of homologous regions retrieved in the search, which included YP 422785, are presented as SEQ ID NOS: 141-253.

FIGS. 8A-8D depict BLAST results for a search with the amino acid sequence for ABC-type protease/lipase transport system, ATPase and permease components (SEQ ID NO:254) from *Magnetospirillum magneticum* AMB-1. Exemplary sequences of homologous regions retrieved in the search, which included the search query *Magnetospirillum magneticum* AMB-1ATPase and permease, are presented as SEQ ID NOS:254-268.

FIGS. 9A-9C depict BLAST results for a search with the amino acid sequence for thermostable lipase TliA (SEQ ID NO:269) from *Pseudomonas flourescens*. Exemplary sequences of homologous regions retrieved in the search are presented as SEQ ID NOS:270-286.

DETAILED DESCRIPTION

Figure 10:
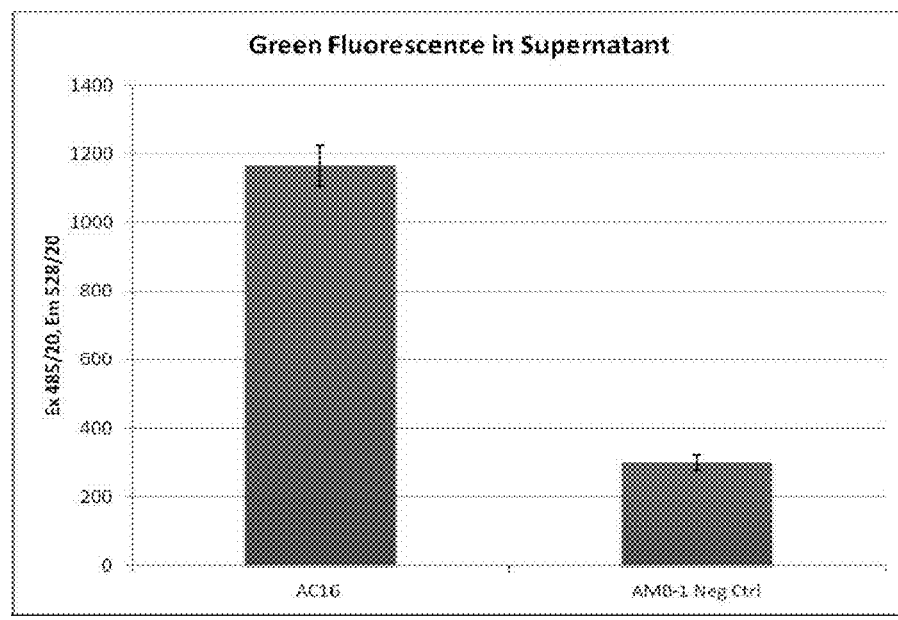
FIG. 10 shows levels of green fluorescence in extracellular supernatants of AC16 cells (*M. magneticum* AMB-1 containing GFP fused to the C-terminal transport sequence of NCBI Accession No. YP_422785) as compared to that of the *M. magneticum* AMB-1 negative control (denoted as AMB-1 Neg Ctrl) (see Example 4).
Figure 11:
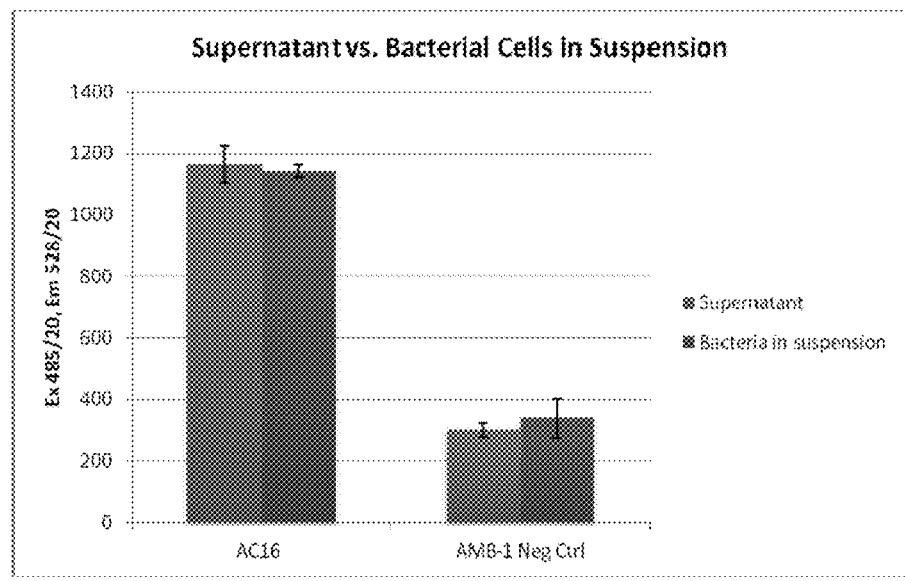
FIG. 11 shows levels of green fluorescent protein fluorescence in supernatants of cultures of AC16 cells as compared to fluorescence levels of suspensions of AC16 cells. Also shown are fluorescence levels of supernatant of *M. magneticum* AMB-1 Neg Ctrl cells as compared to *M. magneticum* AMB-1 Neg Ctrl cells in suspension.

The present invention is directed to host cells that contain an artificial endosymbiont, wherein the artificial endosymbiont secretes into and/or transports from the host cell a polypeptide, nucleic acid, or other factor. In some embodiments, the factor, e.g., a protein or nucleic acid, is secreted into the host cell and produces a phenotype in the host cell, particularly a phenotype not present prior to the introduction of the artificial endosymbiont into the host cell. In some embodiments, the artificial endosymbiont secretes into and/ or transports from the host cell two or more factors (i.e., multiple factors). In some embodiments, secretion into the host cell can use the endogenous secretion machinery and secretion signals (e.g., sequences) of the artificial endosymbiont, or the artificial endosymbiont engineered to contain the secretion systems for transport of the factor into the host cell.

Before various embodiments of the present invention are further described, it is to be understood that this disclosure is not limited to the particular embodiments described, as such may, of course, vary. It is also to be understood that the terminology used herein is for the purposes of describing particular embodiments only, and is not intended to be limiting.

It is also to be noted that as used in the present disclosure and in the appended claims, the singular terms "a", "an", and "the" include plural referents unless context clearly indicates otherwise. Similarly, the word "or" is intended to include "and" (and vice versa) unless the context clearly indicates otherwise. In addition, the use of "or" means "and/or" unless stated otherwise.

In addition, the words "comprise," "comprises," "comprising," "include," "includes," and "including" are interchangeable and not intended to be limiting. Where descriptions of various embodiments use the term "comprising," those skilled in the art would understand that in some specific instances, an embodiment can be alternatively described using language "consisting essentially of" or "consisting of."

Numerical limitations given with respect to concentrations or levels of a substance are intended to be approximate. Thus, where a concentration is indicated to be at least (for example) 10 μg, it is intended that the concentration be understood to be at least approximately or about 10 μg.

The section headings used herein are for organizational purposes only and not to be construed as limiting the subject matter described.

DEFINITIONS

As used herein, the term "artificial endosymbiont" refers to a single-celled organism that is or has been introduced into a host cell through human intervention. The single-celled organism secretes to and/or transports from the host cell polypeptide(s), nucleic acid(s), lipid(s), carbohydrate(s), amino acid(s), or other factor(s). And this communication between the single cell organism and the host cell results in a phenotype for the host cell and/or artificial endosymbiont.

As used herein, the term "cellular life cycle" refers to series of events involving the growth, replication, and division of a eukaryotic cell. It is generally divided into five stages, known as $G_0$, in which the cell is quiescent, $G_1$ and $G_2$, in which the cell increases in size, S, in which the cell duplicates its DNA, and M, in which the cell undergoes mitosis and divides.

As used herein, the term "daughter cell" refers to cells that are formed by the division of a cell.

As used herein, the term "essential molecule" refers to a molecule needed by a cell for growth or survival.

As used herein, the term "genetically modified" refers to altering the DNA of a cell so that a desired property or characteristic of the cell is changed.

As used herein, the term "magnetosome" refers to particles of magnetite (i.e., $Fe_3O_4$) or greigite ($Fe_3S_4$) enclosed by a sheath or membrane, either as individual particles or in chains of particles.

As used herein, the term "magnetotactic bacteria" or "MTB" refers to bacteria which are able to orient in a magnetic field.

As used herein, the term "mammal" refers to warm-blooded vertebrate animals all of which are characterized by hair on the skin and, in the female, milk producing mammary glands.

As used herein, the term "phenotype" refers to the set of observable characteristics of an individual resulting from the interaction of its genotype with the environment.

As used herein, the term "secrete" refers to the passing of molecules or signals from one side of a membrane to the other side.

As used herein, the term "heterologous" when used in reference to a nucleic acid or polypeptide refers to a nucleic acid or polypeptide not normally present in nature. Accordingly, a heterologous nucleic acid or polypeptide in reference to a host cell, such as an artificial endosymbiont, refers to a nucleic acid or polypeptide not naturally present in the given host cell. For example, a nucleic acid molecule containing a non-host nucleic acid encoding a polypeptide operably linked to a host nucleic acid comprising a promoter is considered to be a heterologous nucleic acid molecule. Conversely, a heterologous nucleic acid molecule can comprise an endogenous structural gene operably linked with a non-host (exogenous) promoter. Similarly, a peptide or polypeptide encoded by a non-host nucleic acid molecule, or an endogenous polypeptide fused to a non-host polypeptide is a heterologous peptide or polypeptide.

Unless specific definitions are provided, all other technical and scientific terms used herein have the same meaning as commonly understood by one of ordinary skill in the art. Definitions of common terms in molecular biology may be found in, for example, Benjamin Lewin, *Genes V*, Oxford University Press (1994); *The Encyclopedia of Molecular Biology*, John Kendrew, ed., Blackwell Science Ltd. (1994); and *Molecular Biology and Biotechnology: a Comprehensive Desk Reference*, Robert A. Meyers, ed., VCH Publishers, Inc. (1995).

Artificial Endosymbionts

In one aspect, the artificial endosymbionts of the present invention include single-celled organisms, e.g., bacteria, that are capable of surviving in a eukaryotic cell, wherein the artificial endosymbiont secretes into and/or transports from the host cell a polypeptide(s), nucleic acid(s), or other factor(s). In some embodiments, the polypeptide and/or nucleic acid are recombinant or heterologous to the artificial endosymbiont. In some embodiments, the artificial endosymbiont introduces a phenotype into the host cell through the secretion and/or transport between the host cell and the artificial endosymbiont. In some embodiments, this phenotype introduced into the host cell by the artificial endosymbiont is maintained in daughter cells of the host cell. In some embodiments, the host cell maintains the functionality for at least 1 day, 2, 3, 4, 5, 6, 7, 8, 9, 10, 11, 12, 13, 14, 15, 16, 17, 18, 19 or 20 days. In some embodiments, the artificial endosymbiont can stably maintain the phenotype in host daughter cells through at least 3 cell divisions, or at least 4 cell divisions, or at least 5 cell divisions, or at least 6, 7, 8, 9, 10, 11, 12, 13, 14, 15, 16, 17, 18, 19, 20 or more cell divisions. In some embodiments, the artificial endosymbiont can stably maintain phenotype in the host daughter cells through 3-5 divisions, or 5-10 divisions, or 10-15 divisions, or 15-20 divisions.

In some embodiments, the artificial endosymbionts are Proteobacteria, particularly α-Proteobacteria. In the current taxonomic scheme based on 16S rRNA, α-proteobacteria are recognized as a Class within the phylum Proteobacteria, and are subdivided into 7 main subgroups or orders (Caulobacterales, Rhizobiales, Rhodobacterales, Rhodospirillales, Rickettsiales, Sphingomonadales and Parvularculales) (Gupta, R. S., "Phylogenomics and signature proteins for the alpha Proteobacteria and its main groups," *BMC Microbiol.* 7:106, 2007; incorporated herein by reference).

A large number of α-proteobacterial genomes that cover all of the main groups within α-proteobacteria have been sequenced, providing information that can be used to identify unique sets of genes or proteins that are distinctive characteristics of various higher taxonomic groups (e.g., families, orders, etc.) within α-proteobacteria. (Gupta, supra). Analyses of these sequenced genomes show that many species of α-proteobacteria contain transport systems useful in the present invention. FIGS. 1-9 show BLAST homology searches performed at NCBI protein blast website (http://blast.ncbi.nlm.nih.gov/Blast.cgi), and these searches show that many α-proteobacteria species have protein coding sequences homologous to proteins of Type 1 and 5 secretion systems. Thus, in some embodiments, the artificial endosymbionts comprise α-proteobacteria.

In some embodiments, an exemplary α-proteobacteria is magnetotactic bacteria (MTB). MTB are a diverse group of bacteria that belong to different subgroups of the Proteobacteria and Nitrospirae phylum, and are mostly represented within the α-proteobacteria. MTB have a Gram-negative cell wall structure (e.g., inner membrane, periplasm, and outer membrane). They inhabit water bodies or sediments with vertical chemical concentration gradient, predominantly at the oxic-anoxic interface, and thus in some instances categorized as microaerophiles, anaerobic, facultative aerobic or some combination of the three. All MTB are chemoorganoheterotrophic although some marine strains can also grow chemolithoautotrophically (Bazylinski et al., "Chemolithoautotrophy in the marine, magnetotactic bacterial strains MV-1 and MV-2," *Arch Microbiol.* 182(5):373-87, 2004; Williams et al., "Evidence for autotrophy via the reverse tricarboxylic acid cycle in the marine magnetotactic coccus strain MC-1," *Appl Environ Microbiol.* 72(2):1322-9, 2006). All MTB contain magnetosomes, which are intracellular structures comprising magnetic iron crystals enveloped by a phospholipid bilayer membrane (Gorby et al., "Characterization of the bacterial magnetosome membrane," *J Bacteriol.* 170(2):834-41, 1988). In some embodiments, the transport pathways of MTB deliver endogenous and exogenous proteins and/or nucleic acids to the host cell.

A large number of MTB species are known to those of ordinary skill in the art since their initial discovery (Blakemore, R., "Magnetotactic bacteria," *Science* 24:377-79, 1975; Faivre, D. and Schüler, D., "Magnetotactic bacteria and magnetosomes," *Chem Rev.* 108:4875-4898, 2008; publications incorporated herein by reference). MTB have been identified in different subgroups of the Proteobacteria and the *Nitrospira* phylum, with most of the phylotypes grouping in α-Proteobacteria. Currently, culturable MTB strains assigned as α-Proteobacteria by 16S rRNA sequence similarity include the strain originally isolated by Blakemore in 1975, *Magnetospirillum magnetotactium* (formerly *Aquasprillium magnetotactium*), *M. gryphiswaldense, M. magneticum* strain AMB-1, *M. polymorphum, Magnetospirillum* sp. MSM-4 and MSM-6, *Magnetococcus marinus,* marine vibrio strains MV-1 and MV-2, a marine spirillum strain MMS-1 and *Magnetococcus* sp. strain MC-1, as well as others. In some embodiments, all such MTB can be used in the present invention.

Other bacteria useful as artificial endosymbionts include, for example, *Anabaena, Nostoc, Diazotroph, Cyanobacteria, Trichodesmium, Beijerinckia, Clostridium,* Green sulfur bacteria, Azotobacteraceae, *Rhizobia, Frankia,* flavobacteria, Methanosarcinales, aerobic halophilic Archaea of the order Halobacteriales, the fermentative anaerobes of the order Halanaerobiales (low G+C brand of the Firmicutes), the red aerobic *Salinibacter* (Bacteroidetes branch), *Marinobacter, Halomonas, Dermacoccus, Kocuria, Micromonospora, Streptomyces, Williamsia, Tskamurella, Alteromonas, Colwellia, Glaciecola, Pseudoalteromonas, Shewanella, Polaribacter, Pseudomonas, Psychrobacter, Athrobacter, Frigoribacterium, Subtercola, Microbacterium, Rhodoccu, Bacillus, Bacteroides, Propionibacterium, Fusobacterium, Klebsiella,* lecithinase-positive *Clostridia, Veillonella, Fusobacteria,* Chromatiaceae, Chlorobiceae, Rhodospirillaceae, thiobacilli, nitrosomonas, nitrobacter, methanogens, acetogens, sulfate reducers, and lactic acid bacteria.

The genomes of a number of artificial endosymbionts have been or are being sequenced: *M. frigidum, M burtonii, C. symbiosum, C. psychrerythraea, P. haloplanktis, Halorubrum lacusprofundi, Vibrio salmonicida, Photobacterium profundum, S. violacea, S. frigidimarina, Psychrobacter* sp. 273-4, *S. benthica, Psychromonas* sp. CNPT3, *Moritella* sp., *Desulfotalea Psychrophila,* Exiguobacterium 255-15, *Flavobacterium psychrophilum, Psychroflexus torquis, Polaribacter filamentous, P. irgensii, Renibacterium salmoninarum, Leifsonia*-related PHSC20-c1, *Acidithiobacillus ferrooxidans, Thermoplasma acidophilum, Picrophilus torridus, Sulfolobus tokodaii,* and *Ferroplasma acidarmanus.*

Secretion Systems of Artificial Endosymbionts

In the present invention, secretion of protein(s), nucleic acid(s), other molecule(s) and other factor(s) from the artificial endosymbiont, particularly α-proteobacteria and more particularly magnetotactic bacteria, can make use of the endogenous secretion systems of the artificial endosymbiont. In some embodiments, the artificial endosymbiont can be engineered with heterologous secretion systems, or portions thereof, for directed secretion of these target molecules. In some embodiments, these transport systems of the invention are used to transport medically and industrially important genes, recombinant peptides/proteins, and/or other factors that will be useful for therapeutic, biopharmaceutical, agricultural, and industrial applications. However, although various secretion systems are known in the art and described in the present disclosure, it is to be understood that practice of the present invention does not require knowledge or understanding of a specific secretion system. Generally, the signals or sequences that cause secretion of polypeptides or other factors are known for many single celled organisms; they can also be found on known secreted proteins or nucleic acids, or identified based on similarities to sequences found on secreted proteins or nucleic acids. These secretion signals can then be used, particularly as fusions, to direct a target molecule for secretion in the artificial endosymbiont into the host cell without prior knowledge of the specific transport system that directs secretion using the particular secretion signal.

Various secretion systems can be used in the artificial endosymbionts of the disclosure, e.g., a magnetotactic bacteria. For example, the α-proteobacteria have transport pathways that include ABC transporter-based pathways (including the type I secretion system, T1SS), type II secretion systems (T2SS), type III secretion systems (T3SS), type IV secretion systems (T4SS), type V secretion systems (T5SS), type VI secretion systems (T6SS), type VII secretion systems (T7SS), and other transport systems that are known in the art. In some embodiments, these transport systems of α-proteobacteria are used to transport proteins, nucleic acids, and other factors from the artificial endosymbiont into the host cell. In Gram-negative bacteria, secreted proteins are exported across the inner and outer membrane in a single step via the T1SS, T3SS, T4SS, and T6SS pathways. Proteins are exported into the periplasmic space across inner membrane via Sec or two-arginine (Tat) pathways. Proteins are transported across the outer membrane from the periplasmic space by T2SS, T5SS or less commonly by T1SS or T4SS.

T1SS consists of three proteins; an inner membrane protein with a cytoplasmic ATPase domain operating as an ATP-binding cassette (ABC) transporter (*Escherichia coli* HlyB), a periplasmic adaptor (also known as membrane fusion protein, MFP; *E. coli* HlyD), and an outer membrane channel protein of the TolC family (*E. coli* TolC) (reviewed in Delepelaire, P., "Type I secretion in gram-negative bacteria," *Biochem Biophy Acta* 1694:149-61, 2004). These proteins form a pore through the periplasm via which an unfolded protein may be translocated. T1SS protein substrates typically contain carboxy-terminal, glycine- and aspartate-rich repeats known as repeat-in-toxin (RTX) (Linhartova et al., "RTX proteins: a highly diverse family secreted by a common mechanism," *FEMS Microbiol Rev.* 34:1076-1112, 2010; incorporated herein by reference) and are often located close to ABC and MFP genes. Due to its simplicity, T1SS has been used to transport heterologous proteins. Several studies have shown the utility of T1SS to transport exogenous proteins to the extracellular medium (see, e.g., Delepelaire, P., supra; Reed, B and Chen, R., "Biotechnological applications of bacterial protein secretion: from therapeutics to biofuel production," *Res Microbiol.* 164:675-682, 2013; all of which are incorporated herein by reference in their entirety). Low et al. found that cyclodextrin glucanotransferase secretion could be improved by overexpression of the *E. coli* α-haemolysin transporter (Low, K. O. et al., "An effective extracellular protein secretion by an ABC transporter system in *Escherichia coli*: statistical modeling and optimization of cyclodextrin glucanotransferase secretory production," *J Ind Microbiol Biotechnol.* 38: 1587-97, 2011; incorporated herein by reference in its entirety). Su and coworkers also used *E. coli* α-haemolysin secretion systems to secrete protein. By overexpressing HlyBD, two strain-specific components of T1SS, they showed that the recombinant T1SS secreted a high level (1.5 g per liter) of protein from an *E. coli* (Su, L. et al., "Extracellular overexpression of recombinant Thermobifida fusca cutinase by alpha-hemolysin secretion system in *E. coli* BL21 (DE3)," *Microb Cell Fact.* 11:8, 2012; incorporated herein by reference in its entirety). The *E. coli* hemolysin transporter is also known to secrete other heterologous T1SS substrates expressed in *E. coli*, including exotoxins Cya of *Bordatella. pertussis* (Sebo, P., and Ladant, D., "Repeat sequences in the *B. pertussis* adenylate cyclase toxin can be recognized as alternative carboxy-proximal secretion signals by the *E. coli* alpha-haemolysin translocator," *Mol Microbiol.* 9: 999-1009, 1993), LtkA of *Aggregatibacter actinomycetemcomitans* (Lally, E. T. et al., "Analysis of the *Actinobacillus actinomycetemcomitans* leukotoxin gene, Delineation of unique features and comparison to homologous toxins," *J Biol Chem.* 264:15451-456, 1989), PaxA of *Pasteurella aerogenes* (Kuhnert, P. et al., "Characterization of PaxA and its operon: a cohemolytic RTXtoxin determined from pathogenic *Pasteurella aerogenes,*" *Infect. Immun.* 68:6-12, 2000), and FrpA of *Neisseria meningitidis* (Thompson, S. A. and Sparling, P. E., "The RTX cytotoxin-related FrpA protein of *Neisseria miningitidis* is secreted extracellularly by meningococci and by HlyBD+ *Escherichia coli.*" *Infect Immun.* 61:2906-11, 1993; all of which are incorporated herein by reference in their entirety). The assembly of the T1SS complex (best exemplified by *E. coli* hemolysin (Hly) secretion system) is nucleotide-independent, and the translocation of HlyA (the T1SS substrate) requires ATP hydrolysis catalyzed by HlyB (Thanabalu, T. et al., "Substrate-induced assembly of a contiguous channel for the protein export from *E. coli*: reversible bridging of an inner-membrane translocase to an outer membrane exit pore," *EMBO J.* 17:6487-96, 1998; incorporated by reference in its entirety). HlyA is member of the RTX (repeats in toxin) protein family and contains glycine-rich peptide repeats in the C-terminal domain, which have the consensus sequence GGXGXD (X represents any amino acid) (SEQ ID NO:287) and are important for the binding of $Ca^{2+}$ ions. This triggers folding of HlyA in the extracellular medium, which in turn generates the biologically active form of the toxin. The T1SS substrates contain a translocation signal at the C-terminus (last 27 to 218-amino acid fragment of HlyA, minimal secretion signal is located within the last ~60 C-terminal amino acids and is both necessary and sufficient to direct secretion) (Kenny, B. et al., "Analysis of the haemolysin transport process through the secretion from *E. coli* of PCM, CAT or beta-galactosidase fused to the C-terminal signal domain," *Mol Microbiol.* 5:2557-68, 1991; incorporated herein by reference in its entirety). Proteins targeted to the translocator carry an uncleaved, poorly conserved secretion signal at the extreme C-terminus (absolutely required for secretion) that binds to the nucleotide binding domain of ABC-ATPase (*E. coli* HlyB) in a reaction reversible by ATP that mimic initial movement of HlyA into the translocation channel and rapid transport of HlyA to the extracellular medium (Holland B. et al., "Type 1 protein secretion in bacteria, the ABC-transporter dependent pathway (Review)," *Mol Membr Biol.* 22:29-39, 2005; incorporated herein by reference in its entirety).

T1SS from *Pseudomonas fluorescens* is also known and has been used to secrete recombinant proteins. Park et al. found a 105 amino acid polypeptide as the minimal region for recognition and transport by the lipase ABC transporter. A fusion of a target protein to this minimal region allowed secretion of recombinant protein (Park, Y. et al., "Identification of the minimal region in lipase ABC transporter recognition domain of *Pseudomonas fluorescens* for secretion and fluorescence of green fluorescent protein," *Microb. Cell. Fact.* 11:60, 2012; incorporated herein by reference in its entirety). The versatility of T1SS for protein secretion is seen in its wide array of transport substrates, which vary from small proteins like the hemophore HasA (19 kDa) to huge surface layer proteins up to 900 kDa in size (Linhartova et al., "RTX proteins: a highly diverse family secreted by a common mechanism," *FEMS Microbiol Rev.* 34:1076-1112, 2010; Satchell, K. J., "Structure and function of MARTX toxins and other large repetitive RTX proteins," *Annu Rev Microbiol.* 65:71-90, 2011; all of which are incorporated herein by reference in their entirety). Other proteins secreted by T1SS include, for example: adenylate cyclases, lipases and proteases.

Another T1SS system that can be used in the invention is RaxABC from *Xanthomonas oryzae* pv. *oryzae*. Phylogenetic analysis identifies RaxB as an ABC transporter (da Silva, F. G. et al., "Bacterial genes involved in type I secretion and sulfation are required to elicit the rice Xa21-mediated innate immune response," *Mol Plant Microbe Interact.* 17:593-601, 2004; incorporated herein by reference in its entirety), equivalent to HlyB from *E. coli*. The RaxABC transport system is used to secrete AvrXa21 molecules (small sulfated polypeptides), metalloproteases, adhesion factors and glycanases (Delepelaire, P., "Type I secretion in gram-negative bacteria," *Biochim Biophys Acta* 1694: 149-161, 2004; Reddy, J. D. et al., "TolC is required for pathogenicity of *Xylella fastidioa* in *Vitis vinifera* grapevines," *Mol Plant Microbe Interact.* 20:403-410, 2007; all of which are incorporated herein by reference in their entirety).

Autotransporter systems, a subset of T5SS, provide potentially the simplest mechanism for extracellular secretion of recombinant proteins. An autotransporter consists of an N-terminal Sec-dependent signal sequence, a passenger domain and a C-terminal beta-motif. The translocation is a two-step process. The target protein is transported into the periplasm using Sec-dependent transport whereupon the beta-motif forms a transmembrane pore through which the passenger domain is secreted out of the periplasm (Dautin, N. and Barnstein, H. D., "Protein secretion in gram-negative bacteria via the autotransporter pathway," *Annu Rev Microbiol.* 61:89-112, 2007; Thanassi, D. G., et al., "Protein secretion in the absence of ATP: the autotransporter, two-partner secretion and chaperone/usher pathways of gram-negative bacteria (Review)," *Mol Membr Biol.* 22:63-72, 2005; all of which are incorporated herein by reference in their entirety). The beta-motif can be cleaved, allowing translocation of the target protein out of the cell (Leyton, D. L. et al., "From self sufficiency to dependence: mechanism and factors important for autotransporter biogenesis," *Nat Rev Microbiol.* 10:213-25, 2012; incorporated herein by reference in its entirety).

For transport in the T5SS system, the target protein is fused with the N-terminal signal sequence and the C-terminal signal, beta-domain that mediate translocation of a recombinant protein through the inner and outer membranes, respectively. This chimera gene has the N-terminal signal sequence fused in frame to the N-terminal end of the target gene, and a second, in frame fusion to DNA encoding the beta-domain sequence at the C-terminal end of the target gene. In some embodiments, the passenger domain may be replaced in the fusion protein. For example, Jong et al. defined passenger domains of *E. coli* autotransporter hemoglobin-binding protease (Hbp) that could be replaced in a fusion protein to facilitate secretion, along with an intact beta-domain (Jong, W. S. et al., "A structurally informed autotransporter platform for efficient heterologous protein secretion and display," *Microb Cell Fact.* 11:85, 2012; incorporated herein by reference in its entirety). As such, the Hbp (NCBI Accession no. 088093, 1377 amino acids) passenger domains that can be replaced by heterologous proteins include the following: (1) 53-308; (2) 533-608; (3) 657-697; (4) 735-766; (5) 898-922 amino acids:

```
                                         (SEQ ID NO: 288)
MNRIYSLRYSAVARGFIAVSEFARKCVHKSVRRLCFPVLLLIPVLFSAG

SLAGTVNNELGYQLFRDFAENKGMFRPGATNIAIYNKQGEFVGTLDKAA

MPDFSAVDSEIGVATLINPQYIASVKHNGGYTNVSFGDGENRYNIVDRN

NAPSLDFHAPRLDKLVTEVAPTAVTAQGAVAGAYLDKERYPVFYRLGSG

TQYIKDSNGQLTKMGGAYSWLTGGTVGSLSSYQNGEMISTSSGLVFDYK

LNGAMPIYGEAGDSGSPLFAFDTVQNKWVLVGVLTAGNGAGGRGNNWAV

IPLDFIGQKFNEDNDAPVTFRTSEGGALEWSFNSSTGAGALTQGTTTYA

MHGQQGNDLNAGKNLIFQGQNGQINLKDSVSQGAGSLTFRDNYTVTTSN

GSTWTGAGIVVDNGVSVNWQVNGVKGDNLHKIGEGTLTVQGTGINEGGL

KVGDGKVVLNQQADNKGQVQAFSSVNIASGRPTVVLTDERQVNPDTVSW

GYRGGTLDVNGNSLTFHQLKAADYGAVLANNVDKRATITLDYALRADKV

ALNGWSESGKGTAGNLYKYNNPYTNTTDYFILKQSTYGYFPTDQSSNAT

WEFVGHSQGDAQKLVADRFNTAGYLFHGQLKGNLNVDNRLPEGVTGALV

MDGAADISGTFTQENGRLTLQGHPVIHAYNTQSVADKLAASGDHSVLTQ

PTSFSQEDWENRSFTFDRLSLKNTDFGLGRNATLNTTIQADNSSVTLGD

SRVFIDKNDGQGTAFTLEEGTSVATKDADKSVFNGTVNLDNQSVLNIND

IFNGGIQANNSTVNISSDSAVLGNSTLTSTALNLNKGANALASQSFVSD

GPVNISDATLSLNSRPDEVSHTLLPVYDYAGSWNLKGDDARLNVGPYSM

LSGNINVQDKGTVTLGGEGELSPDLTLQNQMLYSLFNGYRNIWSGSLNA

PDATVSMTDTQWSMNGNSTAGNMKLNRTIVGFNGGTSPFTTLTTDNLDA

VQSAFVMRTDLNKADKLVINKSATGHDNSIWVNFLKKPSNKDTLDIPLV

SAPEATADNLFRASTRVVGFSDVTPILSVRKEDGKKEWVLDGYQVARND

GQGKAAATFMHISYNNFITEVNNLNKRMGDLRDINGEAGTWVRLLNGSG

SADGGFTDHYTLLQMGADRKHELGSMDLFTGVMATYTDTDASADLYSGK

TKSWGGGFYASGLFRSGAYFDVIAKYIHNENKYDLNFAGAGKQNFRSHS

LYAGAEVGYRYHLTDTTFVEPQAELVWGRLQGQTFNWNDSGMDVSMRRN

SVNPLVGRTGVVSGKTFSGKDWSLTARAGLHYEFDLTDSADVHLKDAAG

EHQINGRKDSRMLYGVGLNARFGDNTRLGLEVERSAFGKYNTDDAINAN

IRYSF
```

Many *E. coli* autotransporters can also be used in the present invention. Ko et al. used the YfaL autotransporter (NCBI accession no. P45508) to secrete proteins ranging from 25.3 to 143 kDa from *E. coli* (Ko, H. J., et al., "Functional cell surface display and controlled secretion of diverse agarolytic enzymes by *Escherichia coli* with a novel ligation-independent cloning vector based on the autotransporter YfaL," *Appl Environ Microbiol.* 78:3051-58, 2012; incorporated herein by reference in its entirety). The YfaL autotransporter comprises the following sequence:

```
                                         (SEQ ID NO: 289)
MRIIFLRKEYLSLLPSMIASLFSANGVAAVTDSCQGYDVKASCQASRQS

LSGITQDWSIADGQWLVFSDMTNNASGGAVFLQQGAEFSLLPENETGMT

LFANNTVTGEYNNGGAIFAKENSTLNLTDVIFSGNVAGGYGGAIYSSGT

NDTGAVDLRVTNAMFRNNIANDGKGGAIYTINNDVYLSDVIFDNNQAYT

STSYSDGDGGAIDVTDNNSDSKHPSGYTIVNNTAFTNNTAEGYGGAIYT

NSVTAPYLIDISVDDSYSQNGGVLVDENNSAAGYGDGPSSAAGGFMYLG

LSEVTFDIADGKTLVIGNTENDGAVDSIAGTGLITKTGSGDLVLNADNN

DFTGEMQIENGEVTLGRSNSLMNVGDTHCQDDPQDCYGLTIGSIDQYQN

QAELNVGSTQQTFVHALTGFQNGTLNIDAGGNVTVNQGSFAGIIEGAGQ

LTIAQNGSYVLAGAQSMALTGDIVVDDGAVLSLEGDAADLTALQDDPQS

IVLNGGVLDLSDFSTWQSGTSYNDGLEVSGSSGTVIGSQDVVDLAGGDN

LHIGGDGKDGVYVVVDASDGQVSLANNNSYLGTTQIASGTLMVSDNSQL

GDTHYNRQVIFTDKQQESVMEITSDVDTRSDAAGHGRDIEMRADGEVAV

DAGVDTQWGALMADSSGQHQDEGSTLTKTGAGTLELTASGTTQSAVRVE

EGTLKGDVADILPYASSLWVGDGATFVTGADQDIQSIDAISSGTIDISD

GTVLRLTGQDTSVALNASLFNGDGTLVNATDGVTLTGELNTNLETDSLT

YLSNVTVNGNLTNTSGAVSLQNGVAGDTLTVNGDYTGGGTLLLDSELNG

DDSVSDQLVMNGNTAGNTTVVVNSITGIGEPTSTGIKVVDFAADPTQFQ

NNAQFSLAGSGYVNMGAYDYTLVEDNNDWYLRSQEVTPPSPPDPDPTPD

PDPTPDPDPTPDPEPTPAYQPVLNAKVGGYLNNLRAANQAFMMERRDHA

GGDGQTLNLRVIGGDYHYTAAGQLAQHEDTSTVQLSGDLFSGRWGTDGE
```

-continued

```
WMLGIVGGYSDNQGDSRSNMTGTRADNQNHGYAVGLTSSWFQHGNQKQG

AWLDSWLQYAWFSNDVSEQEDGTDHYHSSGIIASLEAGYQWLPGRGVVI

EPQAQVIYQGVQQDDFTAANRARVSQSQGDDIQTRLGLHSEWRTAVHVI

PTLDLNYYHDPHSTEIEEDGSTISDDAVKQRGEIKVGVTGNISQRVSLR

GSVAWQKGSDDFAQTAGFLSMTVKW
```

In some embodiments, a protease (e.g., a tobacco etch virus protease) is used to cleave the C-terminus of the fusion proteins to remove the beta-domain and autotransporter, resulting in secretion from the cell. Sevastsyanovich et al. utilized the *E. coli* serine protease Pet to cleave fusion proteins and provide for complete secretion of a range of proteins varying in sizes and structures, including multi-component proteins (Sevastsyanovich, Y. R. et al., "A generalized module for the selective extracellular accumulation of recombinant proteins," *Microb Cell Fact.* 11:69, 2012; incorporated herein by reference in its entirety). Pet is one of the serine protease autotransporters of the Enterobacteriaceae (SPATEs) that releases passenger domain from the beta-domain.

An application of an autotransporter for consolidated bioprocessing uses an *E. coli* autotransporter Antigen 43 (Ag43) engineered to secrete a target protein. This autotransporter system is unique in that the passenger domain Ag43alpha is self-cleaved, yet the secreted domain is non-covalently attached to the beta-domain, forming an integral outer-membrane protein. In order to secrete the recombinant protein, the segment of Ag43alpha containing the cleavage mechanism was fused to a target sequence. When engineered into an *E. coli* strain, the self-cleaving autotransporter secreted target protein out of the cell (Wargacki, A. J. et al., "An engineered microbial platform for direct biofuel production from brown macroalgae," *Science* 335:308-13, 2012; incorporated herein by reference in its entirety).

A very large number of proteins are secreted via the T5SS, more even than the T2SS (Jacob-Dubuisson, F. et al., "Protein secretion through autotransporter and two-partner pathway," *Biochem Biophy Acta* 1694:235-57, 2004; Dautin, N. and Bernstein, H. D., "Protein secretion in the gram-negative bacteria via autotransporter pathway," *Ann Rev Microbiol.* 61:89-112, 2007). Most of the T5SS secreted proteins characterized to date are virulence factors. Proteins secreted via the T5SS include adhesins such as AIDA-I and Ag43 of *E. coli*, Hia of *Haemophilus influenzae*, YadA of *Yersinia enteroliticola*, and Prn of *Bordetella pertussis*; toxins such as VacA of *Helicobacter pylori*; proteases such as IgA proteases of *Neisseria gonorrheae* and *Neisseria meningitides*, SepA of *Shigella flexneri* and PrtS of *Serratia marcescens*; and S-layer proteins such as rOmpB of *Rickettsia* sp. and Hsr of *Helicobacter pylori*. T5bSS (TPS) secreted proteins include adhesins such as HecA/HecB of the plant pathogen *Dickeya dadantii* (*Erwinia chrysanthemii*) and cytolysins such as ShlA/ShlB of *Serratia marcescens*, HpmA/HpmB of *Proteus mirabilis* and EthA/EthB of *Edwardsiellla tarda*.

The type IV secretion system (T4SS) is a versatile, multi-component secretion system used by both gram-negative and gram-positive bacteria to secrete proteins, DNA, and protein-DNA complexes into a wide range of targeted eukaryotic and bacterial cells (Fronzes, R. et al., "The Structural Biology of Type IV Secretion Systems," *Nat Rev Microbiol* 7(10):703-14, 2009; Backert, S. and T. F. Meyer, "Type IV Secretion Systems and Their Effectors in Bacterial Pathogenesis," *Curr Opin Microbiol* 9(2): 207-17, 2006; all of which are hereby incorporated by reference in their entirety) and can be divided into three groups (Fronzes, R. et al., supra; incorporated herein by reference in its entirety). Group 1 T4SSs mediate the conjugative transfer of plasmid DNA or transposons into a wide range of bacterial species. For example, *E. coli* and *Agrobacterium tumefaciens* can deliver DNA substrates into fungal, plant of human cells (Grohmann, E. et al., "Conjugative Plasmid Transfer in Gram-Positive Bacteria," *Microbiol Mol Biol Rev* 67(2): 277-301, 2003; Lawley, T. D. et al., "F Factor Conjugation Is a True Type Iv Secretion System," *FEMS Microbiol Lett.* 224(1):1-15, 2003; Trieu-Cuot, P. et al., "In Vivo Transfer of Genetic Information between Gram-Positive and Gram-Negative Bacteria," *EMBO J.* 4(13A):3583-7, 1985; all of which are hereby incorporated by reference in their entirety). T4SSs in group 2, such as those found in *Helicobacter pylori* and *Neisseria* gonorrhea, mediate the uptake and release of DNA into the extracellular environment (Smeets, L. C. and J. G. Kusters, "Natural Transformation in *Helicobacter Pylori*: DNA Transport in an Unexpected Way," *Trends Microbiol.* 10(4) 159-62, 2002 (discussion 162); Hamilton, H. L. and J. P. Dillard, "Natural Transformation of *Neisseria Gonorrhoeae*: From DNA Donation to Homologous Recombination," *Mol Microbiol.* 59(2): 376-85, 2006; all of which are hereby incorporated by reference in their entirety). Group 3 T4SSs deliver effector molecules into eukaryotic cells during infection. *H. pylori*, *Brucella suis* and *Legionella pneumophila* are examples of bacteria that use their T4SSs to inject virulence proteins into mammalian host cells (Backert, S. and Meyer, T. F., "Type IV Secretion Systems and Their Effectors in Bacterial Pathogenesis," *Curr Opin Microbiol.* 9(2): 207-17, 2006; Corbel, M. J., "Brucellosis: An Overview," *Emerg Infect Dis* 3(2): 213-21, 1997; Ninio, S. and C. R. Roy, "Effector Proteins Translocated by *Legionella Pneumophila*: Strength in Numbers," *Trends Microbiol.* 15(8):372-80, 2007; all of which are hereby incorporated by reference in their entirety). *A. tumefaciens* uses its group 3 T4SS to deliver oncogenic DNA and proteins into plant cells (Fronzes, R. et al., "The Structural Biology of Type IV Secretion Systems," *Nat Rev Microbiol.* 7(10):703-14, 2009; incorporated herein by reference in its entirety).

Genes encoding components of the T4SS are usually arranged in a single or several operons. *H. pylori* is an example of a bacterium that encodes multiple T4SSs. *H. pylori* has an effector protein delivery system encoded by the cag pathogenicity island and a DNA release and uptake system encoded by the comB gene cluster (Backert, S. and T. F. Meyer, "Type IV Secretion Systems and Their Effectors in Bacterial Pathogenesis," *Curr Opin Microbiol.* 9(2) 207-17, 2006; Smeets, L. C. and Kusters, J. G., "Natural Transformation in *Helicobacter Pylori*: DNA Transport in an Unexpected Way," *Trends Microbiol.* 10(4): 159-62, 2002; all publications incorporated herein by reference in their entirety).

Depending on the structural components that compose a T4SS, the systems can be broadly classified as either type IVA or type IVB systems (Voth, D. E. et al., "Bacterial Type IV Secretion Systems: Versatile Virulence Machines," *Future Microbiol.* 7(2):241-57, 2011; incorporated herein by reference in its entirety). *A. tumefaciens* T4SS and those that resemble it fall into the type IVA secretion systems. The prototypic T-DNA or VirB secretion system of *A. tumefaciens* is the most well characterized T4SS. The *A. tumefaciens* T4SS transporter complex and others similar to it typically consist of 11 VirB proteins (encoded by the virB1- virB11 genes) and the coupling protein VirD4, an NTPase (Tegtmeyer, N., S. Wessler and S. Backert, "Role of the Cag-Pathogenicity Island Encoded Type Iv Secretion System in *Helicobacter Pylori* Pathogenesis," *FEBS J.* 278(8): 1190-202, 2011; incorporated herein by reference in its entirety). Agrobacterial VirB proteins are grouped into three categories: core components, pilus-associated components and energetic components. T4SSs that fall under the type IV B classification were demonstrated in *Legionella pneumophila* to consist of twenty-two structural proteins and 5 chaperone proteins (Vogel, J. P. et al., "Conjugative Transfer by the Virulence System of *Legionella Pneumophila*," *Science* 279(5352): 873-6, 1998; Segal, G., M. et al., "Host Cell Killing and Bacterial Conjugation Require Overlapping Sets of Genes within a 22-Kb Region of the *Legionella Pneumophila* Genome," *Proc Natl Acad Sci. USA* 95(4):1669-74, 1998; all publications incorporated herein by reference in their entirety).

Type IVA secretion systems and Type IVB secretion systems recognize different but overlapping translocation signals. A recent study showed that two *Brucella* effectors can be translocated by *L. pneumophila* demonstrating that a type IVB secretion system can recognize translocation signals from type IVA secretion system effectors (de Jong, M. F. et al., "Identification of Vcea and Vcec, Two Members of the Vjbr Regulon That Are Translocated into Macrophages by the *Brucella* Type Iv Secretion System," *Mol Microbiol.* 70(6):1378-96, 2008; incorporated herein by reference in its entirety).

The following are examples of T4SS translocation signals. The *A. tumefaciens* translocation signal resides in a hydrophilic C-terminal region with a consensus R-X(7)-R-X-R-X-R-X-X(n) motif (SEQ ID NO:290) (Vergunst, A. C. et al., "Positive Charge Is an Important Feature of the C-Terminal Transport Signal of the Virb/D4-Translocated Proteins of *Agrobacterium*," *Proc Natl Acad Sci. USA* 102(3):832-7, 2005; incorporated herein by reference in its entirety). *Bartonella* has a BID domain and a short positively charged tail sequence that together form a bipartite C-terminal translocation signal (Schulein, R. et al., "A Bipartite Signal Mediates the Transfer of Type IV Secretion Substrates of *Bartonella Henselae* into Human Cells," *Proc Natl Acad Sci. USA* 102(3):856-61, 2005; incorporated herein by reference in its entirety). In *Helicobacter pylori*, there is evidence that both the N- and C-terminal ends of the CagA protein have translocation signals. Hohlfeld et al. observed that residues 6-26 of CagA are important for translocation (Hohlfeld, S. et al., "A C-Terminal Translocation Signal Is Necessary, but Not Sufficient for Type IV Secretion of the *Helicobacter Pylori* Caga Protein," *Mol Microbiol.* 59(5):1624-37, 2006; incorporated herein by reference in its entirety). Hohlfeld et al. also show that CagA translocation depends on the presence of its 20 C-terminal amino acids (Hohlfeld, S. et al., supra).

Type 1, 4, and 5 secretion system genes have also been identified in the MTB *Magnetospirillum* sp., strain AMB-1 genome by sequence alignments. AMB-1 contains 83 genes that are involved in cell motility and secretion (Matsunaga, T. et al., "Complete genome sequence of the facultative anaerobic magnetotactic bacterium *Magnetospirillum* sp. AMB-1," *DNA Res.* 12:157-166, 2005; incorporated herein by reference in its entirety). There are at least seven genes present in MTB that encode for RTX proteins. Several putative T1SS substrates (YP_420631.1, YP_420638.1, YP_420640.1, YP_421364.1, YP_422662.1, YP_422785.1, and YP_423419.1) have been identified in MTB (*M. magneticum* AMB-1) (Linhartova et al., "RTX proteins: a highly diverse family secreted by a common mechanism," *FEMS Microbiol. Rev.* 34:1076-1112, 2010; incorporated herein by reference in its entirety). These substrates have been annotated as large exoprotein, type 5 secretory pathway, repeats-in-toxin (RTX) toxins and related $Ca^{2+}$ binding protein, adhesion AidA, and hypothetical protein amb3422 with putative functions such as aminomethyltransferase, adhesion, and cadherin, consistent with type 1 secretion substrates in other bacteria. Exemplary sequences are presented in the Sequence Listing. Moreover, genes responsible for constituting the T1SS complex (such as YP_422838, YP_421739, homolog of *E. coli* HlyB; *E. coli* HlyD membrane fusion protein homologs in MTB gi:83311477, 83312258, 83312575, 83313156 with locus tag amb2378; amb3159; amb3476; amb4057; *E. coli* TolC outer membrane protein homologs in MTB gi:83311344; 83312160; 83312256 with locus tag amb2245; amb3061; amb3157) are present in MTB genome.

FIGS. 1-9 show BLAST alignments of nine MTB proteins that are either secreted or are part of the cells T1SS secretion machinery with the sequenced genes of other α-proteobacteria and other organisms. Each of the sequences, as described by the accession numbers, and the exemplary sequences (e.g., SEQ ID NOS:1-286) can be used in the present invention.

In some embodiments, the protein for secretion can be fused to C-terminal 200 amino acids of YP_420640 (RTX toxins and related $Ca^{2+}$ binding protein), YP_423419 (RTX toxins and related $Ca^{2+}$ binding protein), YP_422785 (amb3422), or other MTB T1SS substrates. Alternatively, the proteins in MTB-YP_420502, YP_420631.1, YP_420638.1, YP_420640.1, YP_421364.1, YP_422662.1, YP_422785.1, and YP_423419.1 may be used for the fusion by taking their C-terminus (e.g., the 200 C-terminal amino acids which contains the secretion signal) to target the recombinant fusion protein to the secretion system. An exemplary C-terminal 200 amino acid sequence containing a secretion signal is that of YP_422785, which has the following sequence:

```
                                        (SEQ ID NO: 291)
DSGTGWIWDPTLNGTSLSVTAHAATTVNGNSTYNGGATADYVIGLGQNEM

VHLGGGADVYAGHGSYNTIGVSDMNFHFLDGGAGGGNTLQWENLNNQAFD

LTGLWNNAVQNFDVLDLSHANNNNAVLDLAHLQSMLNGTNAVTGTGNALV

VIGGNSVTLAGSGWQANGTAELTVNGQHDSYTQYSNGDTHVYVENHTHVG
```

As illustrated by the foregoing, bacteria use diverse machinery to secrete proteins as a means for interacting with their environment, which in case of endosymbionts, includes the environment of the host cell. In some embodiments, the present invention modifies the morphology or the physiology of the host cell (as well as organism) via protein(s), nucleic acid(s), and/or other factor(s) secreted from the artificial endosymbiont through a secretion system.

Modified Artificial Endosymbionts

In some embodiments, the artificial endosymbionts, such as α-proteobacteria, are modified to achieve a higher level of recombinant protein secretion. Methods for genetically modifying artificial endosymbionts can use methods well known in the art for recombinantly modifying single celled organisms. Typically, the artificial endosymbiont is genetically modified to improve secretion of target molecules from the artificial endosymbiont into the host cell. Alternatively, the artificial endosymbiont is engineered to increase transport of a target molecule from the host into the artificial endosymbiont. Modifications may also involve increasing production of proteins or RNA through changing promoter or ribosome binding sequences, or deleting or silencing of certain genes in the artificial endosymbiont.

In some embodiments, the flagellar proteins of an artificial endosymbiont are modified so that the flagellar proteins are no longer expressed. Flagellar proteins have high homology to bacterial secretion systems suggesting a common evolutionary ancestor. In some embodiments, the flagellar proteins of an artificial endosymbiont are modified to create a secretion system. In some embodiments, the single-celled organism is modified so that it can no longer synthesize an essential molecule that is preferably provided by the eukaryotic host cell. In some embodiments, the single-celled organism is genetically modified so that its cell cycle is coordinated with the cell cycle of the eukaryotic host cell so that copy number of the single-celled organism can be maintained at a sufficient level to impart the phenotype to daughter cells.

Molecular biology tools have been developed for genetic manipulations of MTB most extensively in AMB-1 and *M. gryphiswaldense* strain MSR-1 (reviewed in Jogler, C. and Schtiler, D. in Magnetoreception and Magnetosomes in Bacteria, New York, Springer, p 134-138, 2007; incorporated herein by reference). The genomes of two other *Magnetospirillum* strains and *Magnetococcus* sp. strain MC-1 have also been recently sequenced. In some embodiments, genes from these strains or other MTB strains, presently culturable or uncultureable, sequenced or unsequenced, know or unknown, can be used in the present invention.

Several engineering approaches are used to modify artificial endosymbionts, including: (1) engineering into the artificial endosymbiont dedicated secretion systems that naturally exist in other bacteria; (2) engineering cell envelope mutations into the artificial endosymbiont so that it alters the outer membrane or peptidoglycan layer permeability (e.g., Shin, H. and Chen, R. R., "Extracellular recombinant protein production from and *Escherichia coli* lpp deletion mutant," *Biotechnol Bioeng.* 101:1288-96, 2008; incorporated herein by reference in its entirety); and (3) co-expression of a lysis-promoting protein that removes the outer membrane (Ni, Y. and Chen, R., "Extracellular recombinant protein production from and *Escherichia coli,*" *Biotechnol Lett.* 31:1661-70, 2009; incorporated herein by reference in its entirety).

In some embodiments, the *E. coli* α-haemolysin transporter genes HlyB and HlyD are recombinantly expressed in the artificial endosymbiont. Target proteins are then engineered by fusing them with T1SS substrate secretion signal, which is located in C-terminal of HlyA to target them to the α-haemolysin transporter system. The HlyA secretion signal comprises:

(SEQ ID NO: 292)
GNSLAKNVLSGGKGNDKLYGSEGADLLDGGEGNDLLKGGYGNDIYRYLS
GYGHHIIDDDGGKDDKLSLADIDFRDVAFRREGNDLIMYKAEGNVLSIG
HKNGITFRNWFEKESGDISNHQIEQIFDKDGRVITPDSLKKALEYQQSN
NKASYVYGNDALAYGSQDNLNPLINEISKIISAAGNFDVKEERAAASLL
QLSGNASDFSYGRNSITLTASA.

In some embodiments, the T1SS from *Pseudomonas fluorescens* is used to transport recombinant proteins. The T1SS genes such as TliA for the lipase ABC transporter are engineered into the artificial endosymbiont. The target protein is fused N-terminally to a 104 residue, minimal region comprising:

(SEQ ID NO: 293)
GSDGNDLIQGGKGADFIEGGKGNDTIRDNSGHNTFLFSGHFGQDRIIGY
QPTDRLVFQGADGSTDLRDHAKAVGADTVLSFGADSVTLVGVGLGGLWS
EGVLIS.

This fusion of target protein and minimal region allows secretion of recombinant protein. It is interesting to note that there are several proteins exhibiting substantial sequence homology to *P. fluorescens* lipase TliA such as YP_420640, YP_422785, YP_421364, YP_420631, and others that are present in the MTB genome (see, e.g., FIG. 9 and sequences in Sequence Listing). Most of this homology is located in the C-terminal domain of the proteins, which contains the transport signal. In some embodiments, the MTB lipase ABC transport system is used to transport recombinant proteins by fusing target protein to a C-terminal signal of MTB lipase ABC transport system substrates (also see FIG. 9, accession numbers and corresponding sequences in the Sequence Listing for sequence homology). In some embodiments, the C-terminal signal sequence comprises:

(SEQ ID NO: 294)
GAIGGAGAIPGITLVGNAGNDDIIGTNGNDLLLGGKGGATYRFSGGGCG
SGGGWSIVQSDTNDVISAGAGDDVIYGDARLVNGNIQITGSGNDVLDGG
SGNDQIHGGAGNDTIIGGTGDDVMFGDQGNDTFLFDFGFGHDVVDGGRG
SNWTDTLDLTHDNQISSVNIEGVSGWAVSVDAQGHHVAQATNGAHDANG
TIVVTNHDGSQDTIEFHNVEKVVW.

In some embodiments, the RaxA, RaxB and RaxC genes of *Xanthomonas oryzae* pv. *oryzae* are recombinantly expressed in the artificial endosymbiont. The target protein is fused to RaxST, which is the recognition sequence for the RaxABC secretory system. In some embodiments, the RaxST recognition sequence comprises:

(SEQ ID NO: 295)
MLMGMSEEHPSNVQIDDAQRVRLLRAVFDAYYQNRQELGTVFDTNRAWC
SRLTGLARLFPRSRMICCVRDVGWIVDSFERLAQSQPLRLSALFGYDPE
DSVSMHADLLTAPRGVVGYALDGLRQAFYGDHADRLLLLRYDTLAQRPA
QAMEQVYAFLQLPAFAHDYAGVQAEAERFDAALQMPGLHRVRRGVHYVP
RRSVLPPALFDQLQELAFWESAPSHGALLV.

In some embodiments, the target protein is fused at the N-terminal end to a Sec-dependent signal sequence, and the C-terminal end of the target protein is fused to a β-motif. Translocation of such target protein fusions is a two-step process. The target protein is transported into the periplasm using Sec-dependent transport, whereupon the β-motif forms a transmembrane pore in the outer-membrane through which the target protein is secreted from the periplasmic space. The β-motif is cleaved, allowing translocation of the target protein.

In some embodiments, the target protein is fused to an autotransporter (target protein replaced the passenger domain region (29 to 685 amino acids), such as the YfaL autotransporter (Ko, H. J. et al., "Functional cell surface display and controlled secretion of diverse agarolytic enzymes by *Escherichia coli* with a novel ligation-independent cloning vector based on the autotransporter YfaL," *Appl Environ Microbiol.* 78:3051-3058, 2012; incorporated herein by reference in its entirety). The YfaL autotransporter sequence comprises:

```
                                       (SEQ ID NO: 296)
MRIIPLRKEYLSLLPSMIASLFSANGVAAVTDSCQGYDVKASCQASRQS

LSGITQDWSIADGQWLVFSDMTNNASGGAVFLQQGAEFSLLPENETGMT

LFANNTVTGEYNNGGAIFAKENSTLNLTDVIFSGNVAGGYGGAIYSSGT

NDTGAVDLRVTNAMFRNNIANDGKGGAIYTINNDVYLSDVIFDNNQAYT

STSYSDGDGGAIDVTDNNSDSKHPSGYTIVNNTAFTNNTAEGYGGAIYT

NSVTAPYLIDISVDDSYSQNGGVLVDENNSAAGYGDGPSSAAGGFMYLG

LSEVTFDIADGKTLVIGNTENDGAVDSIAGTGLITKTGSGDLVLNADNN

DFTGEMQIENGEVTLGRSNSLMNVGDTHCQDDPQDCYGLTIGSIDQYQN

QAELNVGSTQQTFVHALTGFQNGTLNIDAGGNVTVNQGSFAGIIEGAGQ

LTIAQNGSYVLAGAQSMALTGDIVVDDGAVLSLEGDAADLTALQDDPQS

IVLNGGVLDLSDFSTWQSGTSYNDGLEVSGSSGTVIGSQDVVDLAGGDN

LHIGGDGKDGVYVVVDASDGQVSLANNNSYLGTTQIASGTLMVSDNSQL

GDTHYNRQVIFTDKQQESVMEITSDVDTRSDAAGHGRDIEMRADGEVAV

DAGVDTQWGALMADSSGQHQDEGSTLTKTGAGTLELTASGTTQSAVRVE

EGTLKGDVADILPYASSLWVGDGATFVTGADQDIQSIDAISSGTIDISD

GTVLRLTGQDTSVALNASLFNGDGTLVNATDGVTLTGELNTNLETDSLT

YLSNVTVNGNLTNTSGAVSLQNGVAGDTLTVNGDYTGGGTLLLDSELNG

DDSVSDQLVMNGNTAGNTTVVVNSITGIGEPTSTGIKVVDFAADPTQFQ

NNAQFSLAGSGYVNMGAYDYTLVEDNNDWYLRSQEVTPPSPPDPDPTPD

PDPTPDPDPTPDPEPTPAYQPVLNAKVGGYLNNLRAANQAFMMERRDHA

GGDGQTLNLRVIGGDYHYTAAGQLAQHEDTSTVQLSGDLFSGRWGTDGE

WMLGIVGGYSDNQGDSRSNMTGTRADNQNHGYAVGLTSSWFQHGNQKQG

AWLDSWLQYAWFSNDVSEQEDGTDHYHSSGIIASLEAGYQWLPGRGVVI

EPQAQVIYQGVQQDDFTAANRARVSQSQGDDIQTRLGLHSEWRTAVHVI

PTLDLNYYHDPHSTEIEEDGSTISDDAVKQRGEIKVGVTGNISQRVSLR

GSVAWQKGSDDFAQTAGFLSMTVKW.
```

In some embodiments, a protease is included to cleave the β-motif from the target protein, such as for example, a tobacco etch virus protease, *E. coli* serine protease Pet, and serine protease autotransporters of the Enterobacteriaceae (SPATEs), that releases passenger domain from the β-domain, without requiring exogenous protease. In some embodiments, an *E. coli* autotransporter Antigen 43 (Ag43) is used with the target protein. The Antigen 43 autotransporter sequence comprises:

```
                                       (SEQ ID NO: 297)
MKRHLNTCYRLVWNHMTGAFVVASELARARGKRGGVAVALSLAAVTSLP

VLAADIVVHPGETVNGGTLANHDNQIVFGTTNGMTISTGLEYGPDNEAN

TGGQWVQDGGTANKTTVTSGGLQRVNPGGSVSDTVISAGGGQSLQGRAV

NTTLNGGEQWMHEGAIATGTVINDKGWQVVKPGTVATDTVVNTGAEGGP

DAENGDTGQFVRGDAVRTTINKNGRQIVRAEGTANTTVVYAGGDQTVHG

HALDTTLNGGYQYVHNGGTASDTVVNSDGWQIVKNGGVAGNTTVNQKGR

LQVDAGGTATNVTLKQGGALVTSTAATVTGINRLGAFSVVEGKADNVVL

ENGGRLDVLTGHTATNTRVDDGGTLDVRNGGTATTVSMGNGGVLLADSG

AAVSGTRSDGKAFSIGGGQADALMLEKGSSFTLNAGDTATDTTVNGGLF

TARGGTLAGTTTLNNGAILTLSGKTVNNDTLTIREGDALLQGGSLTGNG

SVEKSGSGTLTVSNTTLTQKAVNLNEGTLTLNDSTVTTDVIAQRGTALK

LTGSTVLNGAIDPTNVTLASGATWNIPDNATVQSVVDDLSHAGQIHFTS

TRTGKFVPATLKVKNLNGQNGTISLRVRPDMAQNNADRLVIDGGRATGK

TILNLVNAGNSASGLATSGKGIQVVEAINGATTEEGAFVQGNRLQAGAF

NYSLNRDSDESWYLRSENAYRAEVPLYASMLTQAMDYDRIVAGSRSHQT

GVNGENNSVRLSIQGGHLGHDNNGGIARGATPESSGSYGFVRLEGDLMR

TEVAGMSVTAGVYGAAGHSSVDVKDDDGSRAGTVRDDAGSLGGYLNLVH

TSSGLWADIVAQGTRHSMKASSDNNDFRARGWGWLGSLETGLPFSITDN

LMLEPQLQYTWQGLSLDDGKDNAGYVKFGHGSAQHVRAGFRLGSHNDMT

FGEGTSSRAPLRDSAKHSVSELPVNWWVQPSVIRTFSSRGDMRVGTSTA

GSGMTFSPSQNGTSLDLQAGLEARVRENITLGVQAGYAHSVSGSSAEGY

NGQATLNVTF.
```

In some embodiments, the translocase of the outer mitochondrial membrane (TOM complex) is engineered into the artificial endosymbiont. The TOM complex includes the receptors Tom20, Tom22, Tom70 and the channel-forming protein Tom40, and several other small subunits (reviewed in Hoogenraad, N. J. et al., *Biochem Biophy Acta* 1592: 97-105, 2002; Neupert W. and Herrmann, J. M., *Annu Rev Biochem.* 76:723-749, 2007; and Chacinska, A. et al., *Cell* 138:628-44, 2009; all publications incorporated herein by reference). Tom20 recognizes the substrate and transfers to centrally located Tom22, where the substrate is inserted into the Tom40 channel. Upon substrate import, TOM complex forms a complex with the translocase of the inner membrane (TIM complex) (Chacinska, A. et al., *EMBO J* 22:5370-81, 2003; incorporated herein by reference). The TIM complex consists of four integral membrane proteins, Tim23, Tim17, Tim50, and Tim21 Tim23 forms the protein-conducting channel of the translocase and is tightly associated with Tom17, whereas, Tim50 acts as regulator for the Tim23 channel and Tim21 transiently interacts with the TOM complex via Tom22 (Milisav, I. et al., "Modular structure of the Tim23 preprotein translocase of mitochondria," *J Biol Chem.* 276:25856-25861, 2001; incorporated herein by reference).

Nucleic Acids

In another aspect, the present invention relates to the nucleic acids that encode, at least in part, the individual peptides, polypeptides and proteins secreted in the methods of the present invention. In some embodiments, the nucleic acids may be natural, synthetic or a combination thereof. In some embodiments, the nucleic acids of the invention also include the nucleic acids that are secreted from the artificial endosymbiont into the host cell. The nucleic acids of the invention may be RNA, mRNA, DNA or cDNA.

In some embodiments, the nucleic acids of the invention also include expression vectors, such as plasmids, or viral vectors, or linear vectors, or vectors that integrate into chromosomal DNA. Expression vectors can contain a nucleic acid sequence that enables the vector to replicate in one or more selected host cells. Such sequences are well known for a variety of cells. The origin of replication from the plasmid pBR322 is suitable for most Gram-negative bacteria. In eukaryotic host cells, e.g., mammalian cells, the expression vector can be integrated into the host cell chromosome and then replicate with the host chromosome. Similarly, vectors can be integrated into the chromosome of prokaryotic cells.

Expression vectors also generally contain a selection gene, also termed a selectable marker. Selectable markers are well-known in the art for prokaryotic and eukaryotic cells, including host cells of the invention. Generally, the selection gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. In some embodiments, an exemplary selection scheme utilizes a drug to arrest growth of a host cell. Those cells that are successfully transformed with a heterologous gene produce a protein conferring drug resistance and thus survive the selection regimen. Other selectable markers for use in bacterial or eukaryotic (including mammalian) systems are well-known in the art. In some embodiments, the selectable marker is the target protein or encoded by the nucleic acid secreted by the artificial endosymbiont into the host cell.

In some embodiments, the expression vector for producing a heterologous polypeptide also contains a promoter, which can be a constitutive or an inducible promoter, that is recognized by the host RNA polymerase and is operably linked to the nucleic acid encoding the target protein. Inducible or constitutive promoters (or control regions) with suitable enhancers, introns, and other regulatory sequences are well-known in the art.

In some embodiments, it may be desirable to modify the polypeptides of the present invention. One of skill will recognize many ways of generating alterations in a given nucleic acid construct to generate variant polypeptides Such well-known methods include site-directed mutagenesis, PCR amplification using degenerate oligonucleotides, exposure of cells containing the nucleic acid to mutagenic agents or radiation, chemical synthesis of a desired oligonucleotide (e.g., in conjunction with ligation and/or cloning to generate large nucleic acids) and other well-known techniques (see, e.g., Gillam and Smith, *Gene* 8:81-97, 1979; Roberts et al., *Nature* 328:731-734, 1987).

In some embodiments, the recombinant nucleic acids encoding the polypeptides of the invention are modified to provide preferred codons which enhance translation of the nucleic acid in a selected organism.

The polynucleotides of the invention also include polynucleotides including nucleotide sequences that are substantially equivalent to the polynucleotides of the invention. Polynucleotides according to the invention can have at least about 80%, more typically at least about 90%, and even more typically at least about 95%, sequence identity to a polynucleotide of the invention. The invention also provides the complement of the polynucleotides including a nucleotide sequence that has at least about 80%, more typically at least about 90%, and even more typically at least about 95%, sequence identity to a polynucleotide encoding a polypeptide recited above. The polynucleotide can be DNA (genomic, cDNA, amplified, or synthetic) or RNA. Methods and algorithms for obtaining such polynucleotides are well known to those of skill in the art and can include, for example, methods for determining hybridization conditions which can routinely isolate polynucleotides of the desired sequence identities.

Nucleic acids which encode protein analogs or variants in accordance with this invention (i.e., wherein one or more amino acids are designed to differ from the wild type polypeptide) may be produced using site directed mutagenesis or PCR amplification in which the primer(s) have the desired point mutations. For a detailed description of suitable mutagenesis techniques, see Sambrook et al., Molecular Cloning: A Laboratory Manual, Cold Spring Harbor Laboratory Press, Cold Spring Harbor, N.Y. (1989) and/or Current Protocols in Molecular Biology, Ausubel et al., eds, Green Publishers Inc. and Wiley and Sons, N.Y (1994). Chemical synthesis using methods well known in the art, such as that described by Engels et al., *Angew Chem Intl Ed.* 28:716-34, 1989, may also be used to prepare such nucleic acids.

In some embodiments, the nucleic acids encode a variant (i.e., recombinant variant) of the polypeptides of the present invention. As used herein "variant" or "recombinant variant" refers to any polypeptide differing from naturally occurring polypeptides by amino acid insertions, deletions, and substitutions, created using recombinant DNA techniques. Guidance in determining which amino acid residues may be replaced, added, or deleted without abolishing activities of interest, such as enzymatic or binding activities, may be found by comparing the sequence of the particular polypeptide with that of homologous peptides and minimizing the number of amino acid sequence changes made in regions of high homology.

In some embodiments, amino acid "substitutions" for creating variants are preferably the result of replacing one amino acid with another amino acid having similar structural and/or chemical properties, i.e., conservative amino acid replacements Amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid.

In some embodiments, amino acid "insertions" or "deletions" for the variants are typically in the range of about 1 to 5 amino acids. The variation allowed may be experimentally determined by systematically making insertions, deletions, or substitutions of amino acids in a polypeptide molecule using recombinant DNA techniques and assaying the resulting recombinant variants for activity.

Alternatively, in some embodiments, where alteration of function is desired, insertions, deletions or non-conservative alterations can be engineered in the nucleic acid to produce altered polypeptides or chimeric polypeptides, e.g., variant polypeptides. Such alterations can, for example, alter one or more of the biological functions or biochemical characteristics of the polypeptides of the invention. For example, such alterations may change polypeptide characteristics such as ligand-binding affinities or degradation/turnover rate. Further, such alterations can be selected so as to generate polypeptides that are better suited for expression, scale up, and the like in the host cells chosen for expression.

Alternatively, recombinant nucleic acids encoding these same or similar polypeptides may be synthesized or selected by making use of the "redundancy" in the genetic code. Various codon substitutions, such as the silent changes which produce various restriction sites, may be introduced to optimize cloning into a plasmid or viral vector or expression in a particular prokaryotic or eukaryotic system. Mutations in the polynucleotide sequence may be reflected in the polypeptide or domains of other peptides added to the polypeptide to modify the properties of any part of the polypeptide, to change characteristics such as ligand-binding affinities, or degradation/turnover rate.

In some embodiments, nucleic acid or polynucleotides encoding the novel nucleic acids are changed via site-directed mutagenesis. This method uses oligonucleotide sequences that encode the polynucleotide sequence of the desired amino acid variant, as well as a sufficient adjacent nucleotide on both sides of the changed amino acid to form a stable duplex on either side of the site of being changed. In general, the techniques of site-directed mutagenesis are well known to those of skill in the art and this technique is exemplified by publications such as, Edelman et al., *DNA* 2:183, 1983. A versatile and efficient method for producing site-specific changes in a polynucleotide sequence is described in Zoller and Smith, *Nucleic Acids Res.* 10:6487-500, 1982.

In some embodiments, PCR may also be used to create amino acid sequence variants of the novel nucleic acids. When small amounts of template DNA are used as starting material, primer(s) that differs slightly in sequence from the corresponding region in the template DNA can generate the desired amino acid variant. PCR amplification results in a population of product DNA fragments that differ from the polynucleotide template encoding the target at the position specified by the primer. The product DNA fragments replace the corresponding region in the plasmid and this gives the desired amino acid variant.

A further technique for generating amino acid variants is the cassette mutagenesis technique described in Wells et al., *Gene* 34:315, 1985; and other mutagenesis techniques well known in the art, such as, for example, the mutagenesis techniques described in Sambrook et al., supra, and Current Protocols in Molecular Biology, referenced herein.

Host Cells

In another aspect, the present invention provides a eukaryotic host cell containing an artificial endosymbiont, wherein the artificial endosymbiont imparts a phenotype to the host cell by secreting proteins, nucleic acids, and/or other factors from the artificial endosymbiont into the host cell. In some embodiments, the artificial endosymbiont is heritable.

In the present invention, various eukaryotic cells can be used as the host cell. In some embodiments, the host cells of the invention are animal cells. In some embodiments, the host cells are mammalian cells, such as that of mouse, rat, rabbit, hamster, porcine, bovine, feline, or canine. In some embodiments, the mammalian cells are cells of primates, including but not limited to, monkeys, chimpanzees, gorillas, and humans. In some embodiments, the mammalians cells are mouse cells, as mice routinely function as a model for other mammals, most particularly for humans (see, e.g., Hanna, J. et al., "Treatment of sickle cell anemia mouse model with iPS cells generated from autologous skin," *Science* 318:1920-23, 2007; Holtzman, D. M. et al., "Expression of human apolipoprotein E reduces amyloid-β deposition in a mouse model of Alzheimer's disease," *J Clin Invest.* 103(6):R15-R21, 1999; Warren, R. S. et al., "Regulation by vascular endothelial growth factor of human colon cancer tumorigenesis in a mouse model of experimental liver metastasis," *J Clin Invest.* 95: 1789-1797, 1995; each publication incorporated herein by reference) Animal cells include, for example, fibroblasts, epithelial cells (e.g., renal, mammary, prostate, lung), keratinocytes, hepatocytes, adopicytes, endothelial cells, hematopoietic cells. In some embodiments, the animal cells are adult cells (e.g., terminally differentiated, dividing or non-dividing) or embryonic cells (e.g., blastocyst cells, etc.).

In some embodiments, the host cell is a cancer cell, including human cancer cells. Many cancer cell lines that are well known to those of ordinary skill in the art can be used as a host cell, including common epithelial tumor cell lines such as Coco-2, MDA-MB231 and MCF7, and non-epithelial tumor cell lines, such as HT-1080 and HL60, the NCI60-cell line panel (see, e.g., Shoemaker, R., "The NCI60 human tumor cell line anticancer drug screen," *Nature Reviews Cancer* 6:813-23, 2006; incorporated herein by reference). Additionally, those of ordinary skill in the art are familiar with obtaining cancer cells from primary tumors. Cancer cells also include, for example, solid tumor cell types, hematopoietic cancer cells, carcinomas, sarcomas, leukemias, lymphomas, gliomas, as well as specific tissue related cancers such as prostate cancer, breast cancer, lung cancer, colorectal cancer, pancreatic cancer, melanoma, glioblastoma, liver cancer, and the NCI 60 panel of cancer cell lines.

In some embodiments, the host cells are stem cells. Variety of stem cells types are known in the art and can be used as host cells, including for example, embryonic stem cells, inducible pluripotent stem cells, hematopoietic stem cells, neural stem cells, epidermal neural crest stem cells, mammary stem cells, intestinal stem cells, mesenchymal stem cells, olfactory adult stem cells, testicular cells, and progenitor cells (e.g., neural, angioblast, osteoblast, chondroblast, pancreatic, epidermal, etc.).

In some embodiments, the host cell is a cell found in the circulatory system of a mammal, including humans. Exemplary circulatory system cells include, among others, red blood cells, platelets, plasma cells, T-cells, natural killer cells, or the like, and precursor cells of the same. As a group, these cells are defined to be circulating host cells of the invention. The present invention may be used with any of these circulating cells. In some embodiments, the host cell is a T-cell. In some embodiments, the host cell is a B-cell. In some embodiments, the host cell is a neutrophil. In some embodiments, the host cell is a megakaryocyte.

In some embodiments, the host cell is a plant cell. In some embodiments, the host cells are cells of monocotyledonous or dicotyledonous plants including, but not limited to, maize, wheat, barley, rye, oat, rice, soybean, peanut, pea, lentil and alfalfa, cotton, rapeseed, canola, pepper, sunflower, potato, tobacco, tomato, eggplant, eucalyptus, a tree, an ornamental plant, a perennial grass, or a forage crop. In some embodiments, the host cells are algal, including but not limited to algae of the genera *Chlorella, Chlamydomonas, Scenedesmus, Isochrysis, Dunaliella, Tetraselmis, Nannochloropsis*, or *Prototheca*. In some embodiments, the host cells are fungi cells, including but not limited to, fungi of the genera *Saccharomyces, Klyuveromyces, Candida, Pichia, Debaromyces, Hansenula, Yarrowia, Zygosaccharomyces,* or *Schizosaccharomyces.*

In some embodiments, at least one gene from the host cell is genetically altered. In some embodiments, mutual nutritional dependence (biotrophy) may be established between the artificial endosymbiont and the host cell by genetic modification of the host cell, using the appropriate molecular biology techniques specific to the target host cell type known to those of ordinary skill in the art, to create host cell dependence on the artificial endosymbiont for some essential macromolecule thus establishing the environmental pressures for biotrophy. In some embodiments, nutritional dependence for an artificial endosymbiont on the host cell can be established by genetically altering the host cell to eliminate the ability of the host cell to synthesize various metabolites, cofactors, vitamins, nucleotides, or other essential molecules. In such embodiments, the essential molecule may be provided by the artificial endosymbiont. For example, an exemplary host cell gene for modification is the gene encoding the enzyme serine hydroxymethyltransferase, which converts serine into glycine at the terminus of the 3-phosphoglycerate biosynthetic pathway for amino acid production. Inactivation of this gene in the host cell would create a host cell dependent on or favoring an artificial endosymbiont that produces glycine.

Methods of Introducing Artificial Endosymbionts into Host Cells

The single-celled organisms of the invention can be introduced into host cells by a number of methods known to those of skill in the art including, but not limited to, microinjection, natural phagocytosis, induced phagocytosis, macropinocytosis, other cellular uptake processes, liposome fusion, erythrocyte ghost fusion, electroporation, receptor mediated methods, and the like (see, e.g., *Microinjection and Organelle Transplantation Techniques,* Celis et al., eds., Academic Press, New York (1986), and references cited therein; incorporated herein by reference in its entirety).

In some embodiments, a single-celled organism is introduced into the host cell by microinjection into the cytoplasm of the host cell. A variety of microinjection techniques are known to those skilled in the art. Microinjection is an efficient transfer technique (essentially 100%) and has no cell type restrictions (Id.; Xi, Z. and Dobson, S., "Characterization of *Wolbachia* transfection efficiency by using microinjection of embryonic cytoplasm and embryo homogenate," *Appl Environ Microbiol.* 71(6):3199-204, 2005; Goetz, M. et al., "Microinjection and growth of bacteria in the cytosol of mammalian host cells," *Proc Natl Acad Sci. USA* 98:12221-6, 2001; each publication incorporated herein by reference).

Naturally phagocytotic cells have been show to take up bacteria, including MTB (Burdette, D. L. et al., "*Vibrio* VopQ induces PI3-kinase independent autophagy and antagonizes phagocytosis," *Mol Microbiol.* 73:639, 2009; Wiedemann, A. et al., "*Yersinia enterocolitica* invasin triggers phagocytosis via β1 integrins, CDC42Hs and WASp in macrophages," *Cell Microbiol.* 3:693, 2001; Hackam, D. J. et al., "Rho is required for the initiation of calcium signaling and phagocytosis by Fcγ receptors in macrophages," *J Exp Med.* 186(6):955-66, 1997; Matsunaga, T. et al., "Phagocytosis of bacterial magnetite by leucocytes. *Appl Microbiol Biotech.* 31(4): 401-5, 1989; all publications incorporated herein by reference).

In some embodiments, non-phagocytotic cell types can be induced to endocytose bacteria by co-culturing with various factors: media, chemical factors, and biologic factors (e.g., baculovirus, protein factors, genetic knock-ins, etc.) (see, e.g., Salminen, M. et al., "Improvement in nuclear entry and transgene expression of baculoviruses by disintegration of microtubules in human hepatocytes," *J Virol.* 79(5):2720-8, 2005; Modalsli, K. R. et al., "Microinjection of HEp-2 cells with coxsackie B1 virus RNA enhances invasiveness of *Shigella flexneri* only after prestimulation with UV-inactivated virus," *APMIS* 101:602-6, 1993; Hayward, R. D. and Koronakis, V., "Direct nucleation and bundling of actin by the SipC protein of invasive *Salmonella,*" *EMBO J.* 18:4926-34, 1999; Yoshida, S. et al., "*Shigella* deliver an effector protein to trigger host microtubule destabilization, which promotes Rac1 activity and efficient bacterial internalization," *EMBO J.* 21: 2923-35, 2002; Bigildeev et al., *Exp Hematol.* 39:187, 2011; Finlay, B. B. and Falkow, S., "Common themes in microbial pathogenicity revisited. *Microbiol Mol Biol Rev.* 61:136-69, 1997; each publication incorporated herein by reference in its entirety).

In some embodiments, the related process of macropinocytosis or "cell drinking," a method numerous bacteria and viruses employ for intracellular entry, can be used to introduce the artificial endosymbiont into the host cell (Zhang, In: Molecular Imaging and Contrast Agent Database (MICAD) [database online] (2004); Bethesda (Md.): National Library of Medicine (US), NCBI 2004-2011; each publication incorporated herein by reference). Various protocols can be employed to induce cells to take up bacteria. Several agents, such as nucleic acids, proteins, drugs and organelles have been encapsulated in liposomes and delivered to cells (Ben-Haim, N. et al., "Cell-specific integration of artificial organelles based on functionalized polymer vesicles," *Nano Lett.* 8(5):1368-73, 2008; Lian, W. et al., "Intracellular delivery can be achieved by bombarding cells or tissues with accelerated molecules or bacteria without the need for carrier particles," *Exp Cell Res.* 313(1):53-64, 2007; Heng, B. C. and Cao, T, "Immunoliposome-mediated delivery of neomycin phosphotransferase for the lineage-specific selection of differentiated/committed stem cell progenies: Potential advantages over transfection with marker genes, fluorescence-activated and magnetic affinity cell-sorting," *Med. Hypotheses* 65(2):334-6, 2005; Potrykus, *Ciba Found Symp.* Vol. 1 54:198, 1990; each publication incorporated herein by reference). This method is inexpensive, relatively simple and scalable. Additionally, liposome uptake can be enhanced by manipulation of incubation conditions, variation of liposome charge, receptor mediation, and magnetic enhancement (see, e.g., Pan et al., *Int J Pharm.* 358:263, 2008; Sarbolouki, M. N. and Toliat, T., "Storage stability of stabilized MLV and REV liposomes containing sodium methotrexate (aqueous & lyophilized)," *J Pharm Sci Techno.* 52(10):23-27, 1998; Elorza, B. et al., "Comparison of particle size and encapsulation parameters of three liposomal preparations." *J Microencapsul.* 10(2):237-48, 1993; Mykhaylyk, O. et al., "Liposomal Magnetofection," *Methods Mol Bio.* 605:487-525, 2010; each publication incorporated herein by reference).

Erythrocyte-mediated transfer is similar to liposome fusion and has been shown to have high efficiency and efficacy across all cell types tested (Microinjection and Organelle Transplantation Techniques; Celis et al. Eds.; Academic Press: New York (1986), incorporated herein by reference). Typically erythrocytes are loaded by osmotic shock methods or electroporation methods (Schoen, P. et al., "Gene transfer mediated by fusion protein hemagglutinin reconstituted in cationic lipid vesicles," *Gene Therapy* 6:823-32, 1999; Li, L. H. et al., "Electrofusion between heterogeneous-sized mammalian cells in a pellet: potential applications in drug delivery and hybridoma formation," *Biophysical J.* 71:479-86, 1996; Carruthers, A. and Melchior, D. L., "A rapid method of reconstituting human erythrocyte sugar transport proteins," *Biochemistry* 23:2712-18, 1984; each publication incorporated herein by reference). Alternatively, erythrocytes may be loaded indirectly by loading hematopoietic progenitors with single-celled organisms and inducing them to differentiate and expand into erythrocytes containing single-celled organisms.

In some embodiments, electroporation, a commonly used, inexpensive method to deliver factors to cells, can be used to introduce artificial endosymbionts into host cells (Potrykus, I., "Gene transfer methods for plants and cell cultures," *Ciba Found Symp* 154:198-208; discussion 208-112, 1990; Wolbank, S. et al., "Labeling of human adipose-derived stem cells for non-invasive in vivo cell tracking," *Cell Tissue Bank* 8:163-177, 2007; each publication incorporated herein by reference).

In some embodiments, a host cell that naturally endocytoses bacteria (e.g., Chinese hamster ovary (CHO) is used. In some embodiments, the modified single-celled bacteria are added to the CHO culture directly. CHO cells are cultured by standard procedures, such as in Ham's F-12 media with 10% fetal calf serum media, prior to infection with the MTB. Post infection, the media is augmented with additional iron (40 to 80 µM) as either ferric malate or $FeCl_3$. Numerous other cell types internalize bacteria by endocytosis or more specifically phagocytosis; endosymbionts or parasites have their own methods for cellular entry, and these natural processes can be exploited for internalization of the artificial endosymbionts resulting in the generation of so-called symbiosomes. In some embodiments, symbiosomes from one cell can be transplanted to another cell type (i.e., one incapable of endocytosis of artificial endosymbionts) using microinjection, organelle transplantation, and chimera techniques. These host cells are cultured in typical media and with the techniques for the specific cell type.

In some embodiments, a single-celled organism is introduced to the host cell by a liposome mediated process. Mitochondria and chloroplasts, which are larger than MTB, have been efficiently introduced into eukaryotic cells when encapsulated into liposomes (see, e.g., Bonnett, H. T., *Planta* 131:229, 1976; Giles, K. et al., "Liposome-mediated uptake of chloroplasts by plant protoplasts," *In Vitro Cellular & Developmental Biology—Plant* 16(7):581-584; each publication incorporated herein by reference). Numerous liposome fusion protocols and agents are available and can be used by the skilled artisan without undue experimentation (see, e.g., Ben-Haim, N. et al., "Cell-specific integration of artificial organelles based on functionalized polymer vesicles," *Nano Lett.* 8(5):1368-73, 2008; Lian, W. et al., "Intracellular delivery can be achieved by bombarding cells or tissues with accelerated molecules or bacteria without the need for carrier particles," *Experimental Cell Research* 313(1):53-64, 2007; Heng, B. C. and Cao, T., "Immunoliposome-mediated delivery of neomycin phosphotransferase for the lineage-specific selection of differentiated/committed stem cell progenies: Potential advantages over transfection with marker genes, fluorescence-activated and magnetic affinity cell-sorting," *Med. Hypotheses* 65(2):334-6, 2005; Potrykus, Ciba Found Symp, Vol. 1 54:198, 1990; each publication incorporated herein by reference).

Use of Reprogrammed Host Cells

The artificial endosymbionts of the present invention introduce into host cells peptides/proteins, nucleic acids, and/or other factors. These proteins, nucleic acids, or other factors can alter gene transcription or translation, post translational modifications, host cell differentiation, remodeling, proliferation, sensitivity or response to external and/or internal stimuli, metabolic, anabolic or other biochemical processes. In some embodiments, the artificial endosymbiont can control host cells through expression, availability, and delivery of certain transcription factors, growth factors, cytokines, signaling pathway molecules, or other recombinant proteins. The artificial endosymbiont may also introduce a desirable phenotype to the host cell through the proteins, nucleic acids or other factors that are secreted into the host cell from the artificial endosymbiont.

In some embodiments, the proteins, nucleic acids, or other factors secreted from an artificial endosymbiont into the host cell can be used to affect cell viability, proliferation, differentiation, de-differentiation, growth, angiogenesis, neurogenesis, osteogenesis, and detoxification. In some embodiments, the artificial endosymbiont can be used to label the cell, treat a pathology or deficiency, induce cell death, induce wound healing, modify cell signaling, modify gene expression, neutralize intracellular proteins or nucleic acids, or provide metabolic pathways for creating biofuels or new energy sources. In some embodiments, the artificial endosymbiont is used to modify cell function by providing, among others, nutrients, growth factors, proteins, minerals, nucleic acids, therapeutic agents, small molecules, ions, chemokines, polysaccharides, lipids, metals, cofactors, and hormones. In some embodiments, the artificial endosymbiont may also be used to manufacture with the host cell bioremediation agents, enzymes, neurotransmitters, polypeptides, carbohydrates, pesticides, fertilizers, and other desirable compounds. In some embodiments, an endosymbiont can secrete proteins related to energy generation or exchange, such as hydrogenase, nitrogenase, and laccase.

In some embodiments, the artificial endosymbiont can secret an amino acid into the host cell, including, alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, or valine.

In some embodiments, the artificial endosymbiont can secrete into a host cell a nucleic acid, RNA, mRNA, hnRNA, ShRNA, siRNA, microRNA, antisense RNA or DNA, or DNA. Genetic material exchange between an artificial endosymbiont and a host cell can be used for gene therapy, to silence a gene, to transcribe a gene, to replace a gene, to modify expression of a gene, to modify a gene, to introduce a gene or nucleic acid fragment, to bind nucleic acids, or to interact with nucleic acids.

In some embodiments, the artificial endosymbiont can introduce into the host cell signal pathway molecules, such as, for example, receptors, ligands (hormones, neurotransmitters, cytokines, chemokines), ion channels, kinases, phosphatases, DNA bindings proteins (e.g., transcription factors, repressors, enhancers), and the like. An exemplary set of proteins for reprogramming cells are the Yamanaka factors, which include Oct4, Oct3, Sox2, Klf4, c-Myc, NANOG, and Lin28. Expression of all or a subset of the Yamanaka factors can reprogram mature cells into iPS cells (see, e.g., Takahashi et al., "Induction of Pluripotent Stem Cells from Adult Human Fibroblasts by Defined Factors," *Cell* 131(5):861-72, 2007).

In some embodiments, an artificial endosymbiont can be used to sense intracellular moieties to quantify intracellular levels of such moiety, drive release of an agent, drive cell death, drive expression of a gene, label the cell, or sense cell viability, differentiation, or cell cycle stage.

In some embodiments, an artificial endosymbiont can secrete transcription factors used to reprogram a cell, for example Oct4. In some embodiments, an artificial endosymbiont can secrete an enzyme to replace enzyme deficiencies, for example, in a lysosomal storage disease or ALDH2. In some embodiments, an artificial endosymbiont can secrete a moiety to label a cell, such as Calcein, superparamagnetic iron oxide, gadolinium containing reagents, fluorescent proteins, luminescent proteins, magnetic reporters, other reporter proteins (Gilad et al., "MRI Reporter Genes," *J Nucl Med.* 49:1905-08, 2008; incorporated herein by reference). In some embodiments, the artificial endosymbiont can secrete a protein or other factor that provide a beacon for the host cell from a reporter, such as a fluorescent protein (e.g., GFP, RFP, YFP, CFP, etc.), and/or luciferase. Other reporters that can be secreted include, among others, enzymes, epitope tags, and heterologous proteins not normally expressed in the host cell.

Prokaryotes have evolved to survive in many ecological niches and thus have a staggeringly large biodiversity. Conversely, eukaryotes have a much more limited biochemistry but have the ability to create complex structures, tissues and organisms. Thus, in some embodiments, the present invention is used to integrate the biodiversity of prokaryotes into the organismal complexity of eukaryotes. This capability relies on the ability of the artificial endosymbiont and host cell to communicate or transfer various substances or signals from one to the other and vise versa. Specific problems encountered by host cells that are solved by artificial endosymbionts can create a number of new host cells. For example, issues in plant agriculture today include, among others, use of fertilizers; shrinking fresh water supplies; temperature and climate fluctuations; insect, pest and fungal infections; toxic soil environments and diminishing nutritional value. These are all issues that bacteria have solved.

An example of an application of the present invention is providing a source of fixed nitrogen, which is the main component of fertilizers, for the growth of plants and fungi. There is a large and diverse class of microbes that fix atmospheric nitrogen using the enzyme nitrogenase. These include, among others, *Anabaena, Nostoc, Diazotroph, Cyanobacteria,* e.g. the highly significant *Trichodesmium, Beijerinckia, Clostridium,* Green sulfur bacteria, *Azotobacteraceae, Rhizobia,* and *Frankia.* Thus, in some embodiments, artificial endosymbionts derived from such organisms can be used to fix nitrogen from the air and transport a nitrogen containing compound compatible with the host cell's metabolism.

Another application of the present invention is to address concerns regarding fresh water supplies, which could in principle be alleviated if crop plants could be irrigated or grown hydroponically with seawater. This would create a large osmotic stress on the plant cells. Surviving high salt environments is an ecological niche in which halophilic bacteria thrive, including members from flavobacteria, cyanobacteria, proteobacteria, firmicutes, methanosarcinales and halobacteriales. Generally two types of osmotic adaptation have been reported: accumulation of inorganic ions or synthesis of organic osmotic solutes. The former "high-salt in" strategy provided by artificial endosymbionts could reduce the osmotic stress on plant cells, allowing the crop to survive seawater irrigation by concentrating salt ions into the artificial endosymbiont, thus lowering the host cell cytoplasmic salt levels below lethal. This strategy is used by the aerobic halophilic Archaea of the order Halobacteriales, the fermentative anaerobes of the order Halanaerobiales (low G+C brand of the Firmicutes) and the red aerobic *Salinibacter* (Bacteroidetes branch).

In some embodiments, artificial endosymbionts can be used to impart molecular and physiological adaptations, such as tolerability to extreme environments. For example, thermophilic and psychrophilic microbes have colonized temperature and climate extreme environments. Thermophiles have evolved their proteins, membranes and cellular components to withstand temperatures, in the most extreme cases, above 100° C. Artificial endosymbionts could extend the temperature range available to some crops. Artificial endosymbionts derived from psychrophiles or psychrotrophs, may provide cold resistance to plants and fungi. These microorganisms have a range of molecular and physiological adaptations: cold adapted enzymes, unique lipids for membranes that maintain fluidity at lower temperatures, cryoprotectants such as exopolysaccharides and cold shock or antifreeze proteins. The secretion of cryoprotectants into host cells would provide a cold tolerant phenotype. Genera of such bacteria include, among others, *Marinobacter, Halomonas, Dermacoccus, Kocuria, Micromonospora, Streptomyces, Williamsia, Tskamurella, Clostridium, Alteromonas, Colwellia, Glaciecola, Pseudoalteromonas, Shewanella, Polaribacter, Pseudomonas, Psychrobacter, Athrobacter, Frigoribacterium, Subtercola, Microbacterium, Rhodoccus* and *Bacillus.* The genomes of a number of these have or are being sequenced: *M. frigidum, M. burtonii, C. symbiosum, C. psychrerythraea, P. haloplanktis, Halorubrum lacusprofundi, Vibrio salmonicida, Photobacterium profundum, S. violacea, S. frigidimarina, Psychrobacter* sp. 273-4, *S. benthica, Psychromonas* sp. CNPT3, *Moritella* sp., *Desulfotalea psychrophila, Exiguobacterium* 255-15, *Flavobacterium psychrophilum, Psychroflexus torquis, Polaribacter filamentous, P. irgensii, Renibacterium salmoninarum* and *Leifsonia*-related PHSC20-c1.

In some embodiments, artificial endosymbionts are used as remedial measures against pollution and other toxic components in the environment. For example, soil environments can become unsuitable for agriculture due to the presence of toxic levels of heavy metals or other pollutants. Artificial endosymbionts that metabolize these or concentrate them and thus provide a resistant phenotype to the host plant. Classes of microorganisms known as Acidophiles have the ability to tolerate high concentrations of metals (e.g., arsenic, mercury, copper, iron, etc.) and metalloids. The genomes of *Acidithiobacillus ferrooxidans, Thermoplasma acidophilum, Picrophilus torridus, Sulfolobus tokodaii* and *Ferroplasma acidarmanus* have been sequenced, and such organisms can be introduced into host cells to provide tolerance against such toxic environments.

In some embodiments, artificial endosymbionts can be used to produce and deliver essential vitamins, for example, B12, biotin, folic acid, and pantothenate to host cells. Such nutrients are synthesized by several intestinal genera of bacteria, including *Bacteroides, Eubacterium, Propionibacterium,* and *Fusobacterium* (Hooper, L. V. et al., "How host-microbial interactions shape the nutrient environment of the mammalian intestine," *Annu Rev Nutr.* 22:283-307, 2002). *Pseudomonas, Klebsiella,* lecithinase-positive *Clostridia, Veillonella* and *Fusobacteria* produce considerable amounts of Vitamin B12-like material (Albert, M. J. et al., "Vitamin B12 synthesis by human small intestinal bacteria," *Nature* 283:781-82, 1980; incorporated herein by reference).

In some embodiments, the present invention can be used in synthetic biology applications. Over the past decades, advances in genetics, synthetic biology and microbiology have created a large number of engineered microbes for various bioindustrial, biopharmaceutical, and other commercial applications. A limitation of these systems is that the engineered microbe needs to support the genetics and metabolism for both cell viability (e.g., housekeeping functions) and function of the engineered pathways. Artificial endosymbionts provide an alternative strategy because the housekeeping functions are provided by the host, which allows more resources to be dedicated to the engineered functionality in the artificial endosymbiont. In a medical setting, drug eluting artificial endosymbionts could replace cellular functions underlying numerous diseases; returning insulin production to pancreatic cells, restoring hormone or metabolic deficiencies, etc. In an industrial setting, artificial endosymbionts could increase the yields of numerous biosynthesized materials, biofuels, etc.

In some embodiments, artificial endosymbionts that provide carbon, energy (like the endosymbiotically derived mitochondria, hydrogensomes, plastids, mitosomes and mitochondrion-derived organelles) or other metabolites could be useful commercially, for example, enabling animal cells to derive carbon and/or ATP though the Calvin cycle and photosynthesis, thereby allowing use of in-lab grown food stocks. Attempts to transfer chloroplast from plant cells to animal cells have been reported previously (Bonnett, H. T., "On the mechanism of the uptake of Vaucheria; chloroplasts by carrot protoplasts treated with polyethylene glycol," *Planta* 131:229-33, 1976; Giles, K. et al., "Liposome-mediated uptake of chloroplasts by plant protoplasts," *In Vitro Cellular & Developmental Biology—Plant* 16:581-4, 1980; incorporated herein by reference). Since the majority of the chloroplasts proteins are encoded in the nuclear genome it is not surprising that these have yet to be successful. Indeed the definition of an endosymbiotically-derived organelle is transfer of genetic material to the host nuclear genome.

In some embodiments, ATP production using an electron donor other than oxygen could be used to enable various host cells to inhabit new niches, potentially even extraterrestrial. Microorganisms have many ways to produce ATP: phototrophy, chemotrophy, photolithotrophy (examples: cyanobacteria, Chromatiaceae, Chlorobiceae), photoorganotrophy (example Rhodospirillaceae), chemolithotrophy (examples: hydrogen-oxidizing bacteria, *thiobacilli, nitrosomonas, nitrobacter*, methanogens, acetogens) and chemoorganotrophy (examples: pseudomonads, *bacillus*, sulfate reducers, *clostridia*, lactic acid bacteria), and artificial endosymbionts containing such metabolic pathway or artificial endosymbionts engineered to contain such pathways can be introduced into appropriate host cells.

Recently bacteria that produce or conduct electricity have been described. Artificial endosymbionts derived from these bacteria could enable complex tissues to be created that have the ability to interact directly with electronics.

The invention will be better understood from the experimental details which follow. However, one skilled in the art will readily appreciate that the specific methods and results discussed are merely illustrative of the invention as described, and therefore are not intended to be exhaustive or to limit the invention to the precise forms disclosed.

EXAMPLES

Example 1

Translocation of Proteins into Host Cells Using a Type I Secretion System from an Artificial Endosymbiont The type I secretion systems (T1SS) in Gram-negative bacteria can be used to export a variety of proteins of various sizes and diverse functions (their cognate substrates). The MTB genome encodes T1SS genes (Matsunga, T. et al., "Complete genome sequence of the facultative anaerobic magnetotactic bacterium *Magnetospirillum* sp. AMB-1," *DNA Res.* 12:157-66, 2005; incorporated herein by reference in its entirety).

Target protein, green fluorescent protein (GFP), or red fluorescent protein (RFP), is N-terminally fused to C-terminal 200 amino acids of YP_420640 (RTX toxins and related $Ca^{2+}$ binding protein), YP_423419 (RTX toxins and related $Ca^{2+}$ binding protein), YP_422785 (amb3422), or other MTB T1SS substrates. Alternatively, the proteins in MTB-YP_420502, YP_420631.1, YP_420638.1, YP_420640.1, YP_421364.1, YP_422662.1, YP_422785.1, and YP_423419.1 can be used for the fusion by taking their C-terminus (e.g., the 200 C-terminal amino acids which contains the secretion signal) to target the recombinant fusion protein to the secretion system. The DNA encoding the fusion of GFP or RFP with 200 C-terminal amino acids of YP_420640 (RTX toxins and related $Ca^{2+}$ binding protein), YP_423419 (RTX toxins and related $Ca^{2+}$ binding protein), YP_422785 (amb3422), or other MTB T1SS substrates is cloned into pBBR-MSC (Kovach, M. E. et al, pBBR1MCS: a broad-host-range cloning vector," *Biotechniques* 16:800-2, 1994). Translocation of the fusion protein out of the artificial endosymbiont is detected by fluorescence, or immunofluorescence and/or immunoblotting.

In another specific example, the hemolysin (Hly) secretion system of *E. coli* is one of the best studied type I secretion systems (T1SS). Secretion of the hemolysin A toxin (HlyA) is catalyzed by a membrane protein complex (Bakkes, P. J., et al., "The rate of folding dictates substrate secretion by the *Escherichia coli* hemolysin type 1 secretion system," *J Biol Chem.* 285(52):40573-80, 2010) that consists of HlyB, an inner membrane protein that is an ATP binding cassette transporter (Davidson, A. L. and J. Chen "ATP-binding cassette transporters in bacteria," *Annu Rev Biochem.* 73:241-68, 2004), TolC, the outer membrane protein (Koronakis, V., et al. "Crystal structure of the bacterial membrane protein TolC central to multidrug efflux and protein export," *Nature* 405(6789):914-9, 2000), and HlyD, the membrane fusion protein that is anchored to the inner membrane (Johnson, J. M. and G. M. Church, "Alignment and structure prediction of divergent protein families: periplasmic and outer membrane proteins of bacterial efflux pumps," *J Mol Biol.* 287(3):695-715, 1999). Export of HlyA requires ATP hydrolysis by HlyB (Thanabalu, T., et al., "Substrate-induced assembly of a contiguous channel for protein export from *E. coli*: reversible bridging of an inner-membrane translocase to an outer membrane exit pore," *EMBO J.* 17(22):6487-96, 1998). The last 218 C-terminal amino acids of HlyA have been shown to direct the secretion of a large variety of polypeptides through the T1SS (Kenny, B. et al., "Analysis of the haemolysin transport process through the secretion from *Escherichia coli* of PCM, CAT or beta-galactosidase fused to the Hly C-terminal signal domain," *Mol Microbiol.* 5:2557-68, 1991; Mackman, N. et al., "Release of a chimeric protein into the medium from *Escherichia coli* using the C-terminal secretion signal of haemolysin," *EMBO J.* 6, 2835-41, 1987; Holland, I. B., et al., "The mechanism of secretion of hemolysin and other polypeptides from gram-negative bacteria," *J Bioenerg Biomembr.* 22(3):473-91, 1990).

In order to translocate a protein, such as GFP or RFP, out of the bacterial cell into a target host cell via the T1SS, the protein, GFP, for example (GenBank: ABG78037.1) will be fused to the last 218 C-terminal amino acids of HlyA (HlyAN-term 218, UniProtKB/Swiss-Prot: P09983.1, bolded-underlined sequence):

(SEQ ID NO: 298)
MVSKGEELFTGVVPILVELDGDVNGHKFSVSGEGEGDATYGKLTLKFIC

TTGKLPVPWPTLVTTLTYGVQCFSRYPDHMKQHDFFKSAMPEGYVQERT

IFFKDDGNYKTRAEVKFEGDTLVNRIELKGIDFKEDGNILGHKLEYNYN

SHNVYIMADKQKNGIKVNFKIRHNIEDGSVQLADHYQQNTPIGDGPVLL

PDNHYLSTQSALSKDPNEKRDHMVLLEFVTAAGITLGMDELYKGNSLAK

NVLSGGKGNDKLYGSEGADLLDGGEGNDLLKGGYGNDIYRYLSGYGHHI

IDDDGGKDDKLSLADIDFRDVAFRREGNDLIMYKAEGNVLSIGHKNGIT

FKNWFEKESGDISNHQIEQIFDKDGRVITPDSLKKALEYQQSNNKASYV

YGNDALAYGSQGNLNPLINEISKIISAAGNFDVKEERAAASLLQLSGNA

SDFSYGRNSITLTASA

For, example, the GFP-HlyAC-term 218 fusion will be secreted out of the bacterial cell into the host cell via the HlyB-HlyD-TolC complex. The GFP-HlyAC-term 218 fusion as well as the HlyB-HlyD-TolC complex will be engineered into the pBBR1MCS-2 plasmid and be expressed under the control of the tac promoter. Translocation of the GFP-HlyAC-term 218 fusion into target host cells will be monitored by fluorescence microscopy.

Translocation/Secretion Assays (to Demonstrate that Proteins are Secreted from MTB).

Dilute (1:10) overnight cultures of MTB strains harboring the appropriate recombinant plasmids into -continued PDNHYLSTQSALSKDPNEKRDHMVLLEFVTAAGITLGMDELYKISALDR
TARLISTSPSKARSKAETEKAIDELDDRRVYDPRDRAQDKAFKR.

Example 3

Translocation of a Nucleic Acid into a Host Cell Using a Type IV Secretion System from an Artificial Endosymbiont CagA The type 4 secretion system (T4SS) can be used to transfer plasmid DNA from an artificial endosymbiont into a mammalian host cell. Sequence analysis reveals that components of the T4SS system are present in MTB.

Plasmid pBBR-MSC is engineered to include (oriT+ trwABC) for transfer of the plasmid by a T4SS system, and the plasmid is engineered to contain an expression cassette encoding the target protein under control of the HCMV IE1 promoter-enhancer-first intron. The target protein is a selectable marker such as DHFR or glutamate synthetase, or a reporter such as GFP, or a transcription factor such as cMyc.

A mammalian selectable marker can be used as the target gene. These include puromycin N-acetyl-transferase gene for puromycin resistance; blasticidin S deaminase for blasticidin S resistance; and aminoglycoside 3'-phosphotransferase for G418 resistance. If MDA-MB231 is used as a host cell line, 2 ug/ml puromycin, 5 ug/ml blasticidin S, or 1 mg/ml G418 is used for selection.

Plasmid DNA harboring a DNA fragment of interest along with an antibiotic resistance cassette (the choice of cassette will vary depending on the conditions needed) can be introduced into MTB via conjugation with a mating strain of E. coli that is auxotrophic to diaminopimelic acid (DAP). Successful transfer of the plasmid DNA to MTB will result in growth of MTB on MG agar plates in the presence of antibiotic. The E. coli mating strain auxotrophic to (DAP) will ensure that any growth seen on the MG agar plates+ antibiotic will be strictly MTB as no *E. coli* colonies should survive on plates not containing DAP. MTB colonies harboring the plasmid DNA will be cultured in liquid MG growth medium to be used in subsequent experiments where MTB will be introduced into mammalian cells. MTB with the plasmid are introduced into mammalian cells, such as the human breast cancer cell line MDA-MB231. The plasmid will then integrate into the host cell chromosome via non-homologous recombination. Transfer of plasmid nucleic acid from MTB, the artificial endosymbiont, to the host cell (MDA-MB231) is detected by selection for host cells that grow in the presence of 2 ug/ml puromycin, 5 ug/ml blasticidin S, or 1 mg/ml G418. Selected cells are grown and then suitable assays are performed to detect chromosomal integration of the plasmid into the host cell genome, such as for example, in situ hybridizations or Southerns.

Example 4

Transport of Reporter Protein into a Eukaryotic Host Cell

Reporter protein transport construct. A 600 base pair polynucleotide encoding the transport sequence denoted as 422785 (from YP_422785), which is the 200 amino acid (SEQ ID NO:291) C-terminal end of protein amb3422 (accession no. YP_422785), a putative Type 1 Secretion System (T1SS) protein native to *Magnetospirillum magneticum* AMB-1, was fused to a polynucleotide encoding a GFP without a stop codon, referred to as GFPmut3 gene. The polynucleotide encoding the fusion protein was operably linked to the lac promoter and the fusion protein expressed using the extrachromosomal plasmid pBBR1MCS-2. This construct was sequence validated and conjugated into *M. magneticum* AMB-1 to create *M. magneticum* AMB-1 strain AC16.

Measuring Green Fluorescence of Bacterial Cells and Extracellular Supernatant.

*M. magneticum* AMB-1 strain AC16 and non-fluorescent *M. magneticum* AMB-1 were grown in standard media (see, e.g., US patent publication US2013/0183758). Green fluorescence of *M. magneticum* AMB-1 strain AC16, non-fluorescent *M. magneticum* AMB-1, and their respective aliquots of extracellular supernatant were measured using a BioTek® Synergy H1 Microplate Reader with excitation wavelength of 485/20 nm and emission wavelength of 528/20 nm. Both *M. magneticum* AMB-1 strains assessed were adjusted to optical density at wavelength of 400 nm (OD400) of 0.195 to ensure all samples contained the same amount of bacterial cells per unit volume. To assess the presence of green fluorescent protein (GFP) that has been transported out from *M. magneticum* AMB-1 and into the extracellular space, 1 ml aliquots of supernatant from each *M. magneticum* AMB-1 strain with no cells present were obtained via centrifugation at 13,000 rpm for 10 min. Without disturbing the bacterial pellet, 200 µl of the supernatant were pipetted out and dispensed into wells of a black 96-well microplate. In parallel, 200 µl of *M. magneticum* AMB-1 cells in suspension of each strain were dispensed into wells of the microplate in order to assess total green fluorescence from both intracellular and extracellular GFP. This experiment was done in biological and technical triplicates. Measurements of GFP fluorescence in supernatants of AC16 and AMB-1 (negative control) are shown in FIG. 10. Results show that there were significantly higher levels of green fluorescence in the extracellular supernatant of AC16 as compared to that of the *M. magneticum* AMB-1 negative control (denoted as AMB-1 Neg Ctrl). Comparison of fluorescence levels in supernatant of AC16 cells and cells in suspension are shown in FIG. 11. Results show that there was no significant difference between levels of green fluorescence detected in the supernatant of AC16 cells and that detected with AC16 cells in suspension, which indicates that the majority of GFP signal is from the extracellular medium. There is no significant difference between green fluorescence detected in the supernatant of the AMB-1 Neg Ctrl and that detected with the same bacterial cells in suspension, which suggests that this low fluorescence is due to background.

Immunohistochemisty to Detect Translocation of GFP.

To examine the translocation of fusion protein (GFP fused to C-terminal 200 amino acids of YP_422785) from magnetotactic bacteria *Magnetospirillum magneticum* AMB-1 to eukaryotic cells (human breast cancer cells MDA-MB231), MDA-MB231 cells were grown in standard cell culture medium (e.g., DMEM media supplemented with 10% fetal calf serum) and the cells labeled with *M. magneticum* AMB-1 strain AC16, for example by mixing AC16 cells with MDA-MB231 cells and then using a NdFeB, Grade N52 magnet to assist in introduction of the *M. magneticum* AMB-1 cells into the MDA-MB231 cells. The transfer of the fusion protein from magnetotactic bacteria into the extracellular environment was monitored by immunofluorescence microscopy. Briefly, MDA-MB231 cells were labeled with magnetotactic bacteria, and at various time points post-labeling the labeled MDA-MB231 cells were fixed in 4% paraformaldehyde, permeabilized and blocked with 0.1% Triton X-100 and 1% bovine serum albumin. Eukaryotic cells were stained with GFP and AMB-1 antibodies for 1 h at room temperature. Slides were washed and incubated with Alexa Fluor 488 donkey anti-rabbit and Alexa Fluor 594 donkey anti-mouse IgG (H+L) secondary antibodies for 30 min. Slides were washed and mounted with Vectashield with DAPI, and fluorescence images were obtained using fluorescence microscope.

Figure 12:
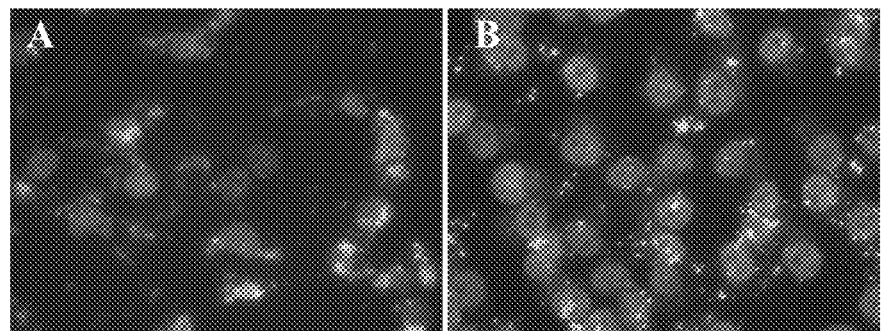
FIG. 12 shows fluorescence microscopy of AMB-1 labeled MDA-MB231 cells (40× images). MDA-MB231 cells were labeled with AMB-1, where the AMB-1 contained (A) only GFP plasmid or (B) GFP-fused to C-terminal 200 amino acids of YP_422785 (i.e., AC16), and dually stained for GFP and AMB-1 one day post-labeling with bacteria and examined by fluorescence microscopy (see Example 4 for details). Both panels are merged images of staining of GFP (red), AMB-1 (green), and DAPI (blue).

FIG. 12 shows fluorescence microscopy images (40×) of MDA-MB231 cells labeled with AMB-1 containing (A) only GFP plasmid and (B) GFP-fused to C-terminal 200 amino acids of YP_422785, one day after labeling with the M. magneticum AMB-1 cells and dually stained with the antibodies. Both panels are merged images of anti-GFP (red), anti-AMB-1 (green), and DAPI (blue). The translocation of GFP-fusion protein (in panel B) to the extracellular environment is revealed by double immunofluorescent staining of AMB-1 labeled MDA-MB231 cells, demonstrating the ability of AMB-1 to transfer proteins into the host cells using type 1 secretion system.

Figure 13:
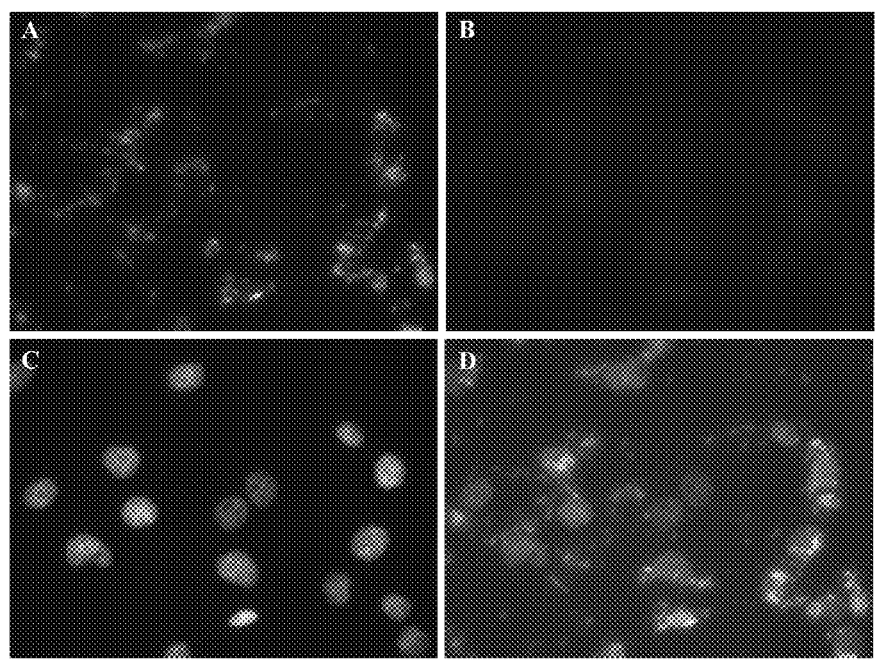
FIG. 13 shows fluorescence microscopy of AMB-1 labeled MDA-MB231 cells (single channel and composite images) (40× images). MDA-MB231 cells were labeled with AMB-1 containing GFP plasmid only, and dually stained one day post-labeling and examined by fluorescence microscopy. Top left panel (A) represents AMB-1 staining (green channel), (B) top right panel GFP staining (red channel), (C) bottom left panel DAPI staining (blue channel), and (D) merged images of AMB-1 (green channel), GFP (red channel), and DAPI (blue channel) staining.

FIG. 13. shows fluorescence microscopy of AMB-1 labeled MDA-MB231 cells (single channel and composite images) (40× images). MDA-MB231 cells were labeled with AMB-1 containing GFP plasmid only (without the secretion sequence), and the cells dually stained one day post-labeling and examined by fluorescence microscopy: (A) AMB-1 only (green channel), (B) GFP (red channel), (C) DAPI (blue channel), and (D) merged images of AMB-1 (green channel), GFP (red channel), and DAPI (blue channel). The translocation of GFP protein (in Panel B) to the extracellular environment was not observed by double immunofluorescent staining of MDA-MB231 cells containing AMB-1 cells containing GFP only.

Figure 14:
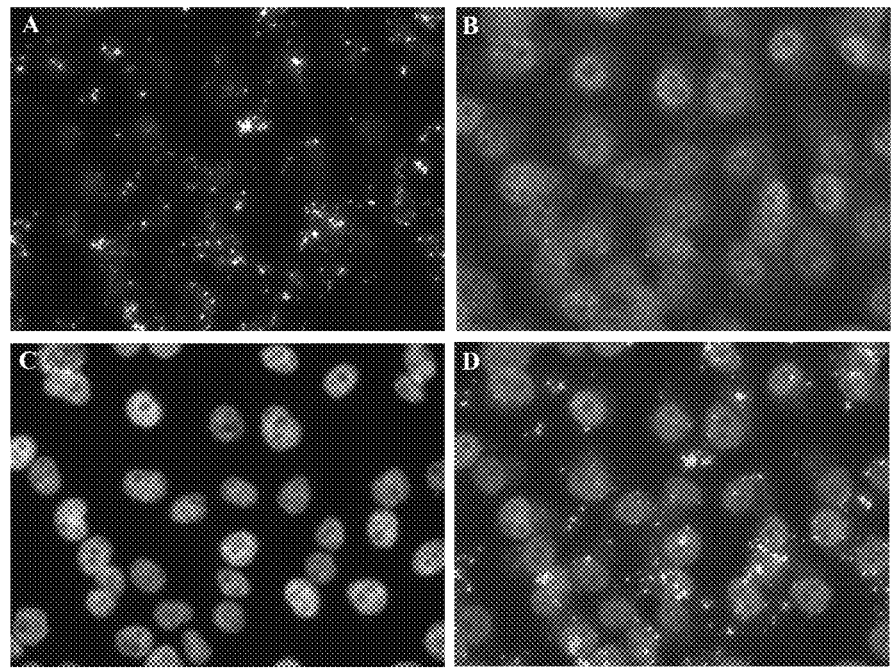
FIG. 14 shows fluorescence microscopy of AMB-1 labeled MDA-MB231 cells (single channel and composite images) (40× images). MDA-MB231 cells were labeled with AMB-1 containing GFP-fused to C-terminal 200 amino acids of YP_422785 (AC16), and dually stained one day post-labeling and examined by fluorescence microscopy. Top left panel (A) represents AMB-1 staining (green channel); top right panel (B) represents GFP staining (red channel); bottom left panel (C) represents DAPI staining (blue channel); and bottom right panel (D) represents merged images of AMB-1 (green channel), GFP (red channel), and DAPI (blue channel) staining.

FIG. 14 shows fluorescence microscopy of MDA-MB231 cells labeled with AC16 cells (single channel and composite images) (40× images). MDA-MB231 cells were labeled with AC16 cells (AMB-1 containing GFP-fused to C-terminal 200 amino acids of YP_422785) and dually stained one day post-labeling and examined by fluorescence microscopy: (A) AMB-1 (green channel), (B) GFP (red channel), (C) DAPI (blue channel), and (D) merged images of AMB-1 (green channel), GFP (red channel), and DAPI (blue channel). The translocation of GFP-fusion protein (in Panel B) to the extracellular environment is revealed by double immunofluorescent staining of AMB-1 labeled MDA-MB231 cells, demonstrating the ability of AMB-1 to transfer proteins into the host cells using type 1 secretion system.

The foregoing descriptions of specific embodiments of the present invention have been presented for purposes of illustration and description. They are not intended to be exhaustive or to limit the invention to the precise forms disclosed, and many modifications and variations are possible in light of the above teaching.

All patents, patent applications, publications, and references cited herein are expressly incorporated by reference to the same extent as if each individual publication or patent application was specifically and individually indicated to be incorporated by reference.

SEQUENCE LISTING (300 sequences)

SEQ ID NO: 1 - protein, 3730 aa, Magnetospirillum magneticum AMB-1
  misc_feature (449)..(449): Xaa can be any naturally occurring amino acid
MTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDRPAGMQACTAVVYXVNDGSASLHACRSTVTIHGSNDSATISGDIAGGVGEDGTGTATGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGANESMTKTFTVTSADGTDTQEVTVTINGSNDGPVVSGPVDLGATAEDHSITFTAQQLLGHASDIDGDSLSVSNLSAGNGTISQNADGSYTFTPNADFNGEVNVTYTVSDGHGGTTSGSASFDVTSVNDGPTTSDVTLASGTEDRSVTIKASDLLGNAHDVDGDTLSVSNLSASNGTITDNHDGTYTFTPNHDFSGNVDLSYTVSDGQGGSTAGTAHFGMAAVADSPVLSASNITVDLGAGQAQTLNGTTGNDTLSGGSGNDVVNGSSGDDVLYGDGTGSVTVPLNISDRLSDTDGSESLGSVTIGGLPAGASLSAGTHNSDGTWTLTPAQLTGLSVTTTEGTALHLSVTATSTEASNGSTATTTTSFDVSFSGTAAGNDTLDGGAGNDTLFGGAGNDTLTGGAGADLLEGGDGNDVLNYSTDGTWSGGFVSQNVGDTTHAGTNETYTITGDNDSQDVFRGGAGTDTLVMGSGNDALFLDDGYSGSPTGGARIDGIESIVAGEGNDVVDLTSSKYTYGDVTIDGGAGNDVLMGNAGNDVIDGGTGNDVLYGASGNDTLRGGDGADTLDGGYGADTIDAGAGNDLGIIKGGQSAGDNYDGGTGTDTLRIDLSGSQYTAAVRAELQQFQSFIADPAHAGQSFHFNTLGVDAKNWESLKLTVDGRDVSLENAPTVTSATAVSTDEDHSGAGRVVGTDQDVGDSVRYHLMDASGNQVDSLSTAHGTVTINSATGEYTFTPNADAQSLRAGDVQTDSFKVVATDGTMTSAPSTVGVTITGSNDGAVITGTSVGTVGEDGNRSVTGTLNVADVDQGQAHVTAQTVQTDQGTFSIGENGQWTFQVNSGNADVQALGAGESMTKTFAVASADGTATQNVTVTINGANDSATISGSTTGAVAEDGNGRATGTLNVADVDHGQAHVTAQTVQTDQGTFSIGENGQWTFQVNSGNADVQALGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTATQNVSVTITGSNDGPTVSGAVGLGHTAEDNSVTFTKAQLLANAHDTDAHDTLSVSNLSAAHGSIVDNGNGTYTFTPTETFSGHVDVSYTVSDGHGGTTTGSAALDVDAVADRATVSVAIGAPVETPNGSFTVTNLDSTASAGYNNTYGYYVMDDSGNPTSGGVIWSNVHASPGASVTISGVDPDRVGFFLIPDGGSQNSGLANGAALTFSKDASGNWQASDSAGHVLSGAGTKVLFDKSALNGDHMVHSEDTSAVSGNQNWEDLTGGGDRDYNDVNMSVTWGNAAPTATHPLTVSASFPDMDGSEGHAVKISGLPSGSTLYQNGVALVAGADGSYSLNPAQLGGLSVKTPAGFNGDLNVNVTAVATDGTSVASSTASATVHDDLSNHGPDAGDATSVHGAMGATITGAAGVTDSDGDHLSYAVGTGTSGPQHGTVVVNTDGTFTYTPSGNYSGTDTFKITVSDGHGGTATETVNVTVENGAPTLTTANAATANDHSAVTGHVTGSDTPGDTLSYSLVDANGNHVGSLVTDHGTVSINAATGDYTFTPNAANASLGVGASVTDSFKVVATDNHGADSNLGTVAVTVTGSNDGPVVNTANVTTANDHTAVSGHAAGTDVDAGDSVRYHLVDASGNQVDSLTTAHGTVSINAATGDYTFTPTGDSSLGVGQTLGDSFKVVAVDNHGAASAPSTVAVTITGSNDGPVVDLVSGGRGTEDSAVRGSVSAHDVDAGDRLSYSLVDSHGSAVGSLATDHGTVSINQTTGEYTFTPNANWAGNETFNVQVSDGHGGTATQAVNVHVDAVADAPVLNLQLGGGSAVTLAGASEDVTITTSNMHATNSGFSVSALNLDGSAGTLSTHSGPDGFGVAGNASGDQAELGQSGGRSEKIVVNFDSDVSSANVSFAWMNSQEHAHYDLYQNGVKVGEGTVTGITDSVDPAISLTAANGGSFDQIVFSAPGGGDNDYLIHSISYEAAEPGERVVNYPLDVSSSLTDTDGSERLAVTLNGLPEGAVILDTHGNVVGTDTGNGTWSLPGGHLDHLTLQVPADSHAFTLGATATATESDPNAAVATATTSVSVAVAAFDHAPVAGDDSHIDTVAQGPALSVSMGTTVDDVHTTTTTTTVETGNNVTWNGLDSMSDPTTATPTTTVSYDLNTANTGSSNADVISVGHDNNASISTGAGDDQVTIGHNVNSKIDLGSGTNALDVGSDVNASVIAGSGNDTVRVGGALNSDIDLGNGDNRLQLGGDSNASVSVGSGNDDVKIVGSLNSNVSLGSGDDDLQIGGYASASIDAGAGNDRVLVGRDLSSKVDLGSGDDYLEVKGNDWASIDAGSGNDTVKIGGAISSNVTMGAGDDHLTITGQNLWATVSGGSGTDSIELTGVTKAQWDANVNNVKGYVKDFENIKFADGQVIGDATAFQATTTVTTTTTTHSYETPITVQATLNDRDGSETLSPVTIANIPAGGHLELNGQALTPNADGSYTLNVSSGAPTTVTLVTDTPVTAGSLNLTTTVSSTEAHGGDVSVTTLVGVGSNAGETVVDDRIATGTDHKVTINASDLLANDTDADGDALSIVGVGNAHHGSVSIDNAGHVTFTAENGFNGTATFDYTVSDGHGGTDVATVSVNVVDPNHAPVIDAAHTTATLVVDDKHANTANIGQVTATDVDGDNLTYSVLDGGSHHGSLVVDADSGSFFYNADDTKWSGTDTFTVQVSDGEGGKATQTISVQVTGGSKGGSGGSGGGHAIGWGNGGGRDESWGSNGSWEVDGAGHSGGGHVTHASDNGSNWSSGWHGVDVGNGGHAGTGDSIDIAGYNRHDESYRGSGGDTLIGAAGNDYMSLEGGDHAQKISGIDHIQLGDGDNVILDMTTTRYDYGDLTVAGGSGHDVIWSASGDDLLVAGNGGNTIHGGAGNDTIVAGAGSDELMGQEGNDTFLFDFGSGHDTVNGGAGTNWTDTIDLSTDMHAGANITITTADNHSWTVASDGDHNATGNIELGQDKSGTITVHSQDGDQTIEFTNIESIKY

SEQ ID NO: 2 - protein, 1578 aa, Magnetospirillum magneticum AMB-1
MTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGANESMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGAGDSMTKTFTVTSADGTDTQEVTVTINGSNDGPVVSGPVDLGATAEDHSITFTAQQLLGHASDIDGDSLSVSNLSAGNGTISQNADGSYTFTPNADFNGEVNVTYTVSDGHGGTTSGSASFDVTSVNDGPTTSDVTLASGTEDRSVTIKASDLLGNAHDVDGDTLSVSNLSASNGTITDNHDGTYTFTPNHDFSGNVDLSYTVSDGQGGSTAGTAHFGMAAVADSPVLSASNITVDLGAGQAQTLNGTTGNDTLSGGSGNDVVNGSSGDDVLYGDGTGSVTVPLNISDRLSDTDGSESLGSVTIGGLPAGASLSAGTHNSDGTWTLTPAQLTGLSVTTTEGTALHLSVTATSTEASNGSTATTTTSFDVSFSGTAAGNDTLDGGAGNDTLFGGAGNDTLTGGAGADLLEGGDGNDVLNYSTDGTWSGGFVSQNVGDTTHAGTNETYTITGDNDSQDVFRGGAGTDTLVMGSGNDALFLDDGYSGSPTGGARIDGIESIVAGDGNDVVDLTSSKYTYGDVTIDGGAGNDVLMGNAGNDVIDGGTGNDVLYGASGNDTLRGGDGADTLDGGYGADTIDAGAGNDLGIIKGGQSAGDNYDGGTGTDTLRIDLSGSQYTAAVRAELQQFQSFIADPAHAGQSFHFNTLGVDAKNWESLKLTVDGRDVSLENAPTVTSATAVSTDEDHSGAGRVVGTDQDVGDSVRYHLMDASGNQVDSLSTAHGTVTINSATGEYTFTPNADAQSLRAGDVQTDSFKVVATDGTMTSAPSTVGVTITGSNDGAVITGTSVGTVGEDGNRSVTGTLNVADVDQGQAHVTAQTVQTDQGTFSIGENGQWTFQVNSGNADVQALGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTAPR

SEQ ID NO: 3 - protein, 804 aa, Magnetospirillum magneticum AMB-1
  misc_feature (666)..(666): Xaa can be any naturally occurring amino acid
MTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGANESMTKTFTVTSADGTDTQEVTVTINGSNDSATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVXDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNND

SEQ ID NO: 4 - protein, 790 aa, Magnetospirillum magneticum AMB-1
  misc_feature (772)..(772): Xaa can be any naturally occurring amino acid
MTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTSTATGTLNVSDVDNGEAHVQATSIETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGAGDSMTKTFTVTSADGTDTQEVTVTINGSNDNATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTIHGSNDSATISGDIAGGVGEDGTSTATGTLNVSDVDXGEAHVQATSVETDQGTFT

SEQ ID NO: 5 - protein, 804 aa, Magnetospirillum magneticum AMB-1
MTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANDSMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANDSMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDSATISGDIAGGVGEDGTSTATGTLHVSDVDTGEAHVQATSVETDQGTFTIGEDGKWSFALNND

SEQ ID NO: 6 - protein, 804 aa, Magnetospirillum magneticum AMB-1
MTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGAGDSMTKTFTVTSADGTDTQEVTVTINGSNDNATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANDSMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLHVSDVDTGEAHVQATSVETDQGTFTIGEDGKWSFALNND

SEQ ID NO: 7 - protein, 684 aa, Magnetospirillum magneticum AMB-1
  misc_feature (109)..(109): Xaa can be any naturally occurring amino acid
TVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTINGXNDTATISGDIAGGVGEDGTGTATGTLNVSDVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGAGDSMTKTFTVTSADGTDTQEVTVTINGSNDNATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTIHGSNDSATISGDIAGGVGEDGTSTATGTLHVSDVDTGEAHVQATSVETDQGTFTIGEDGKWSFALNND

SEQ ID NO: 8 - protein, 804 aa, Magnetospirillum magneticum AMB-1
  misc_feature (433)..(433): Xaa can be any naturally occurring amino acid
MTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTINGXNDTATISGDIAGGVGEDGTGTATGTLNVSDVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGAGDSMTKTFTVTSADGTDTQEVTVTINGSNDNATISGDIAGGVGEDGTSTATGTLNVSDVDNGEAHVQATSIETDQGTFTIGEDGKWSFALNND

SEQ ID NO: 9 - protein, 804 aa, Magnetospirillum magneticum AMB-1
  misc_feature (331)..(331): Xaa can be any naturally occurring amino acid
MTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTINGXNDTATISGDIAGGVGEDGTGTATGTLNVSDVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGAGDSMTKTFTVTSADGTDTQEVTVTINGSNDNATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNND

SEQ ID NO: 10 - protein, 806 aa, Magnetospirillum magneticum AMB-1
  misc_feature (537)..(537): Xaa can be any naturally occurring amino acid
LTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTINGXNDTATISGDIAGGVGEDGTGTATGTLNVSDVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNND

SEQ ID NO: 11 - protein, 727 aa, Magnetospirillum magneticum AMB-1
  misc_feature (662)..(662): Xaa can be any naturally occurring amino acid
IRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTINGXNDTATISGDIAGGVGEDGTGTATGTLNVSDVDNGEAHVQATSVETDQGTFTIGEDGKWSFALNND

SEQ ID NO: 12 - protein, 257 aa, Magnetospirillum magneticum AMB-1
SLSTAHGTVTINSATGEYTFTPNADAQSLRAGDVQTDSFKVVATDGTMTSAPSTVGVTITGSNDGAVITGTSVGTVGEDGNRSVTGTLNVADVDQGQAHVTAQTVQTDQGTFSIGENGQWTFQVNSGNADVQALGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTAPR

SEQ ID NO: 13 - protein, 172 aa, Magnetospirillum magneticum AMB-1
DIQAVAVNHAPIVAGVADIGTIDEDHPLTMTAAEWQAKLLANATDSDGDTLSILSLDDIRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMN

SEQ ID NO: 14 - protein, 1113 aa, Magnetospirillum magneticum AMB-1
MTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGIGTATGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGANESMTKTFTVTSADGTDTQEVTVTINGSNDGPVVSGPVDLGATAEDHSITFTAQQLLGHASDIDGDSLSVSNLSAGNGTISQNADGSYTFTPNADFNGEVNVTYTVSDGHGGTTSGSASFDVTSVNDGPTTSDVTLASGTEDRSVTIKASDLLGNAHDVDGDTLSVSNLSASNGTITDNHDGTYTFTPNHDFSGNVDLSYTVSDGQGGSTAGTAHFGMAAVADSPVLSASNITVDLGAGQAQTLNGTTGNDTLSGGSGNDVVNGSSGDDVLYGDGTGSVTVPLNISDRLSDTDGSESLGSVTIGGLPAGASLSAGTHNSDGTWTLTPAQLTGLSVTTTEGTALHLSVTATSTEASNGSTATTTTSFDVSFSGTAAGNDTLDGGAGNDTLFGGAGNDTLTGGAGADLLEGGDGNDVLNYSTDGTWSGGFVSQNVGDTTHAGTNETYTITGDNDSQDVFRGGAGTDTLVMGSGNDALFLDDGYSGSPTGGARIDGIESIVAGEGND

SEQ ID NO: 15 - protein, 804 aa, Magnetospirillum magneticum AMB-1
  misc_feature (130)..(130): Xaa can be any naturally occurring amino acid
MTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDXATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANDSMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDSATISGDIAGGVGEDGTSTATGTLHVSDVDTGEAHVQATSVETDQGTFTIGEDGKWSFALNND

SEQ ID NO: 16 - protein, 906 aa, Magnetospirillum magneticum AMB-1
  misc_feature (538)..(538): Xaa can be any naturally occurring amino acid
MTKTFTVTSADGTDTQEVTVTINGSNDSATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDXATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLHVSDVDTGEAHVQATSVETDQGTFTIGEDGKWSFALNND

SEQ ID NO: 17 - protein, 804 aa, Magnetospirillum magneticum AMB-1
MTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSNDSATISGDIAGGVGEDGTSTATGTLSVADVDNGEAHVQATSIETDQGTFTIGEDGKWSFALNNDDPAVQALGANESMTKTFTVTSADGTDTQEVTVTINGSNDSATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGAGDSMTKTFTVTSADGTDTQEVTVTINGSNDSATISGDIAGGVGEDGTQAATGTLNVADVDSGEAHVQATSVETDQGTFTIGEDGKWSFALNND

SEQ ID NO: 18 - protein, 780 aa, Magnetospirillum magneticum AMB-1
VNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSNDSATISGDIAGGVGEDGTSTATGTLSVADVDNGEAHVQATSIETDQGTFTIGEDGKWSFALNNDDPAVQALGANESMTKTFTVTSADGTDTQEVTVTINGSNDSATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNND

SEQ ID NO: 19 - protein, 172 aa, Magnetospirillum magneticum AMB-1; identical to SEQ ID NO: 13

SEQ ID NO: 20 - protein, 1230 aa, Magnetospirillum magnetotacticum
TQAVNVHADAVADAPTLSLQLGGGSAVTLPGVSEHVTIDTSNMHATNSGFTVSALNLDGSAGNLSTHSGPAGFGVTGNASGDQTELGQSGGHSEKIVVNFDNDVSSANVSFAWLNNQEHAHYDLYQNGVKVGEGTVTGITDNVDPAISLTAANGGSFDQIVFSAPSGGDNDYLIHSISYDVAEPGERVVNYPLNVSSGLTDTDGSERLAVTLNGLPEGAVVMDANGTVVGTNTGNGTWSLPGGHIDGLTLQVPADSHAFTLGAVATSTESDPNAALATASTSVSVAVAAFDHAPVAGDDSHIDNMAQGPALSVAMGTTVDDVHTTTTTTTVVTGNQVSWGGLDSMSDPTTATPTTTVSNDLNTANNGTANADVISVGHDNNASISTGAGDDQVTIGHSVNSKIDLGAGTNALDVGADVNASVVGGAGNDTVRVGGALNSNIDLGNGDNRLQVGGDASASISTGSGSDDVKIVGSLNSNVSLGSGDDDLQIGGSANASIDAGEGNDRVLVGRDLSSTANLGSGDDYLEVKGNDWASINAGAGNDTVKIGGAISANVDMGSGDDHLTITGQNLWATVSGGSGTDSIELTGVTKAQWDANVNGIKGYVKDFENIKFSDGQVIGDATAFQATTTVTTTTTTHSYETPITVQATLNDRDGSETLSPVTIANIPAGGHLELNGQALTPNSDGSYTLNVSSGSPVTVTLVTDAPVSANSLNLTTTVHSTEAHGGDVSVTTLVGVGSNAGETVVDDRIATGTDHKVVINASDLLANDTDADGDALSITAVGGAHHGTVSMDNAGHVTFTAEAGFNGTATFDYTVSDGHGGTDTATVSVNVVDPNHAPVIDAAHTTATLNIDDAHANTTNIGQVTATDVDGDTLSYSVLAGGTHHGSLVLDANSGSFFYNADDTSWSGTDTFTVQVNDGEGGTATQSVSVHVTGGSQGGKSGGGTGSGHAVGWGDGGGRDESWGANGSWSIDAISGGGSNGGHVVHASDNGTDWSSSWSALDVGNGGHAGTGDRFSIAGDNRHDEFYNGHSGDTLIGAAGNDYMSLEGADGKQHISGYDHIQMGDGDNAILDMTTSHYDYGNLTVAGGTGHDVIWSASGDDLLVAGNGGDTIHGGAGNDTIVAGAGSDNLMGQDGSDTFMFDFGAGHDIVNGGAGATWTDTIDLSTDMHDGASITITTADNHSWTVASDGDHHAAGAIELGQDKAGTITVHSNHGDTQIEFTNIETIKY

SEQ ID NO: 21 - protein, 210 aa, Magnetospirillum magnetotacticum
GGGRDESWGANGSWSIDAISGGGSNGGHVVHASDNGTDWSSSWSALDVGNGGHAGTGDRFSIAGDNRHDEFYNGHSGDTLIGAAGNDYMSLEGADGKQHISGYDHIQMGDGDNAILDMTTSHYDYGNLTVAGGTGHDVIWSASGDDLLVAGNGGDTIHGGAGNDTIVAGAGSDNLMGQDGSDTFMFDFGAGHDIVNGGAGATWTDTIDLS

SEQ ID NO: 22 - protein, 215 aa, Magnetospirillum magnetotacticum
VHSTEAHGGDVSVTTLVGVGSNAGETVVDDRIATGTDHKVVINASDLLANDTDADGDALSITAVGGAHHGTVSMDNAGHVTFTAEAGFNGTATFDYTVSDGHGGTDTATVSVNVVDPNHAPVIDAAHTTATLNIDDAHANTTNIGQVTATDVDGDTLSYSVLAGGTHHGSLVLDANSGSFFYNADDTSWSGTDTFTVQVNDGEGGTATQSVSVHV

SEQ ID NO: 23 - protein, 146 aa, Magnetospirillum magnetotacticum
GTVSMDNAGHVTFTAEAGFNGTATFDYTVSDGHGGTDTATVSVNVVDPNHAPVIDAAHTTATLNIDDAHANTTNIGQVTATDVDGDTLSYSVLAGGTHHGSLVLDANSGSFFYNADDTSWSGTDTFTVQVNDGEGGTATQSVSVHV

SEQ ID NO: 24 - protein, 88 aa, Magnetospirillum magnetotacticum
TGTDHKVVINASDLLANDTDADGDALSITAVGGAHHGTVSMDNAGHVTFTAEAGFNGTATFDYTVSDGHGGTDTATVSVNVVDPNHAP

SEQ ID NO: 25 - protein, 1268 aa, Magnetospirillum magnetotacticum
SVSINPATGEYTFTPNADAQHLGAGVVQADSFQVVASDGSLSSAPTTVNVSITGNNDAATITGSAAGSVGEDGNHSATGHLSVADVDSGQAHVTAQTVETDQGTFSIGTDGNWSFAVNSANADVQALGAGESMTKTFTVASADGTATQEVTVTINGANDSATITGSAAGSVGEDGNHSATGHLSVADVDSGQAHVTAQTVETDQGTFSIGTDGNWSFAVNSANADVQALGANESMTKTFTVASADGTATQEVTVTINGANDSATITGSAAGSVGEDGNHSATGHLSVADVDSGQAHVTAQTVETDQGTFSIGTDGNWSFAVNSANADVQALGAGESMTKTFTVASADGTATQEVTVTINGANDSATITGSAAGSVGEDGNHSATGHLSVADVDSGQAHVTAQTVETDQGTFSIGTDGNWSFAVNSANADVQALGAGESMTKTFAVASADGTATQNVSVTITGSNDGPTVSGAVALGHTAEDNSVTFTTAQLLANAHDVDTHDTLSVSNLTSTHGSIVDNGNGTYTFTPTENYSGHVDVSYTVSDGHGGTAAGSAALDVDAVADRASVSVSIGAAVETPNGSFTVTNLDSTASAGYHNTYGYYVMDDNGNPTSGGVIWSDVHASPNASVTVNGVDPDRVGFFIIPDGGSQNSGLANGAALTFSKDSAGNWQASDSAGHVLSGADSKVLFDNKALNSDHLVHAEDSSAVSGNQNWEDLTGGGDRDYNDVNMSVSWGNAAPTASHALSVSASFPDMDGSESHTVSISGLPAGATLYQNGVALVAGADGSYSLNPAQLGGLSVKTPAGFTGDLNVNVTAVATDGTSVASSSASASVHDDLANHGPDAGDPTSVHGAAGATITSAVGVTDVDGDHLSYAVGTGNNGPQHGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTVSASNVTTANDHTAITGHASGADVDTGDTVAYHLVDGSGNQVDSLTTAHGTVTINSATGDYTFTPTGDASVGVGQTLGDSFKVVVVDNHGAASAPSTVAVTITGSNDGPTVSVANVTTANDHTAITGHASGADVDTGDTVRYHLMDASGNQVDSLTTAHGTVTINSATGDYTFTPTGDASVGVGQTLGDSFKVVAVDNHGAASAPSTVAVTITGSNDGPTVSV

SEQ ID NO: 26 - protein, 437 aa, Magnetospirillum magnetotacticum
SFQVVASDGSLSSAPTTVNVSITGNNDAATITGSAAGSVGEDGNHSATGHLSVADVDSGQAHVTAQTVETDQGTFSIGTDGNWSFAVNSANADVQALGAGESMTKTFTVASADGTATQEVTVTINGANDSATITGSAAGSVGEDGNHSATGHLSVADVDSGQAHVTAQTVETDQGTFSIGTDGNWSFAVNSANADVQALGANESMTKTFTVASADGTATQEVTVTINGANDSATITGSAAGSVGEDGNHSATGHLSVADVDSGQAHVTAQTVETDQGTFSIGTDGNWSFAVNSANADVQALGAGESMTKTFTVASADGTATQEVTVTINGANDSATITGSAAGSVGEDGNHSATGHLSVADVDSGQAHVTAQTVETDQGTFSIGTDGNWSFAVNSANADVQALGAGESMTKTFAVASADGTATQNVSVTITGSNDGP

SEQ ID NO: 27 - protein, 334 aa, Magnetospirillum magnetotacticum
AHVTAQTVETDQGTFSIGTDGNWSFAVNSANADVQALGANESMTKTFTVASADGTATQEVTVTINGANDSATITGSAAGSVGEDGNHSATGHLSVADVDSGQAHVTAQTVETDQGTFSIGTDGNWSFAVNSANADVQALGAGESMTKTFTVASADGTATQEVTVTINGANDSATITGSAAGSVGEDGNHSATGHLSVADVDSGQAHVTAQTVETDQGTFSIGTDGNWSFAVNSANADVQALGAGESMTKTFAVASADGTATQNVSVTITGSNDGPTVSGAVALGHTAEDNSVTFTTAQLLANAHDVDTHDTLSVSNLTSTHGSIVDNGNGTYTF

SEQ ID NO: 28 - protein, 697 aa, Magnetospirillum magnetotacticum
KVSSLTTEHGTVTIDAKTGEYTFTPNDEADKLGVSQSAHDSFSVMVDDGHGGTSTANIGVTITGSNDGPTVSADAVLTGGDEDTSITIHASDLLKNAHDVDVGDTLSVTNLSATNGTITDNHDGTYTFTPNHDFNGQVDLSYTVSDGHGGDTPAKASFDVAAVNDKATLAPDDLVTVDDDTKSEGFAHGSDVDGDTLTYSLVDADGNKVTSLTTDHGTVTIDPDTGKYSFTPNDEADKIGLGQSAHDSFKVVANDGQVDSDVSTVNVTITGSNDGPTVTHIDAVATDEDHAGTGHVAGADVDVGDTVRYHLVDANGNQTDTLVTEHGSVSINPATGEYTFTPNADAQHLGAGVVQADSFQVVASDGSLSSAPTTVNVSITGNNDAATITGSAAGSVGEDGNHSATGHLSVADVDSGQAHVTAQTVETDQGTFSIGTDGNWSFAVNSANADVQALGAGESMTKTFTVASADGTATQEVTVTINGANDSATITGSAAGSVGEDGNHSATGHLSVADVDSGQAHVTAQTVETDQGTFSIGTDGNWSFAVNSANADVQALGANESMTKTFTVASADGTATQEVTVTINGANDSATITGSAAGSVGEDGNHSATGHLSVADVDSGQAHVTAQTVETDQGTFSIGTDGNWSFAVNSANADVQALGAGESMTKTFTVASADGTATQEVTVTINGANDSATITGS

SEQ ID NO: 29 - protein, 326 aa, Magnetospirillum magnetotacticum
VAAVNHAPTTQDGEVTTVDDDTAVKGKVSVNDQDGDSLTFSLVDASGSKVSSLTTEHGTVTIDAKTGEYTFTPNDEADKLGVSQSAHDSFSVMVDDGHGGTSTANIGVTITGSNDGPTVSADAVLTGGDEDTSITIHASDLLKNAHDVDVGDTLSVTNLSATNGTITDNHDGTYTFTPNHDFNGQVDLSYTVSDGHGGDTPAKASFDVAAVNDKATLAPDDLVTVDDDTKSEGFAHGSDVDGDTLTYSLVDADGNKVTSLTTDHGTVTIDPDTGKYSFTPNDEADKIGLGQSAHDSFKVVANDGQVDSDVSTVNVTITGSNDGPTV

SEQ ID NO: 30 - protein, 437 aa, Magnetospirillum magnetotacticum
AVNHAPTTQDGEVTTVDDDTAVKGKVSVNDQDGDSLTFSLVDASGSKVSSLTTEHGTVTIDAKTGEYTFTPNDEADKLGVSQSAHDSFSVMVDDGHGGTSTANIGVTITGSNDGPTVSADAVLTGGDEDTSITIHASDLLKNAHDVDVGDTLSVTNLSATNGTITDNHDGTYTFTPNHDFNGQVDLSYTVSDGHGGDTPAKASFDVAAVNDKATLAPDDLVTVDDDTKSEGFAHGSDVDGDTLTYSLVDADGNKVTSLTTDHGTVTIDPDTGKYSFTPNDEADKIGLGQSAHDSFKVVANDGQVDSDVSTVNVTITGSNDGPTVTHIDAVATDEDHAGTGHVAGADVDVGDTVRYHLVDANGNQTDTLVTEHGSVSINPATGEYTFTPNADAQHLGAGVVQADSFQVVASDGSLSSAPTTVNVSITGNNDAATITGS

SEQ ID NO: 31 - protein, 206 aa, Magnetospirillum magnetotacticum
SGNDDLFGTDGNDLLLGGKGGYTYRYSGGSHGGNVGGCGYSLVDNGTNDVISAGAGDDIIYGDAKMVNGSIQVTGAGNDILDGGAGNDQIHGGGGNDTITGGTGDDVMFGDQGSDTFLFDFGFGHDVVDGGRGSNWTDTLDLTHDNQISAVNIEGVSGWAVSVDAQGHHVAQATNGAHDASGTVIVTNHDGSQDTIEFHNVEKVVW

SEQ ID NO: 32 - protein, 112 aa, Magnetospirillum magnetotacticum
NHAPTTQDGEVTTVDDDTAVKGKVSVNDQDGDSLTFSLVDASGSKVSSLTTEHGTVTIDAKTGEYTFTPNDEADKLGVSQSAHDSFSVMVDDGHGGTSTANIGVTITGSNDG

SEQ ID NO: 33 - protein, 822 aa, Magnetospirillum magneticum AMB-1
CRPLGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTATQNVSVTITGSNDGPTVSGAVGLGHTAEDNSVTFTKAQLLANAHDTDAHDTLSVSNLSAAHGSIVDNGNGTYTFTPTETFSGHVDVSYTVSDGHGGTTTGSAALDVDAVADRATVSVAIGAPVETPNGSFTVTNLDSTASAGYNNTYGYYVMDDSGNPTSGGVIWSNVHASPGASVTISGVDPDRVGFFLIPDGGSQNSGLANGAALTFSKDASGNWQASDSAGHVLSGAGTKVLFDKSALNGDHMVHSEDTSAVSGNQNWEDLTGGGDRDYNDVNMSVTWGNAAPTATHPLTVSASFPDMDGSEGHAVKISGLPSGSTLYQNGVALVAGADGSYSLNPAQLGGLSVKTPAGFNGDLNVNVTAVATDGTSVASSTASATVHDDLSNHGPDAGDATSVHGAMGATITGAAGVTDSDGDHLSYAVGTGTSGPQHGTVVVNTDGTFTYTPSGNYSGTDTFKITVSDGHGGTATETVNVTVENGAPTLTTANAATANDHSAVTGHVTGSDTPGDTLSYSLVDANGNHVGSLVTDHGTVSINAATGDYTFTPNAANASLGVGASVTDSFKVVATDNHGADSNLGTVAVTVTGSNDGPVVTGVTGGTGNESITSARSVVTGHISAGDVDAGDTLSYSVTDNAAAGHHGTLAVNASGDYTFTASDSNWHGTDSFTVQVSDGHGGTVNQTVAITVNAQADAATIN

SEQ ID NO: 34 - protein, 243 aa, Magnetospirillum magneticum AMB-1
PTCRPLGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTATQNVSVTITGSNDGPTVSGAVGLGHTAEDNSVTFTKAQLLANAHDTDAHDTLSVSNLSAAHGSIVDNGNGTYTFTPTETFSGHVDVSYTVSDGHGGTTTGSAALDVDAVADRATVS

SEQ ID NO: 35 - protein, 197 aa, Magnetospirillum magneticum AMB-1
CRPLGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTATQNVSVTITGSNDGPTVSGAVGLGHTAEDNSVTFTKAQLLANAHDTDAHDTLSVSNLSAAHGSIVDNGNGTY

SEQ ID NO: 36 - protein, 201 aa, Magnetospirillum magneticum AMB-1
PTCRPLGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTATQNVSVTITGSNDGPTVSGAVGLGHTAEDNSVTFTKAQLLANAHDTDAHDTLSVSNLSAAHGSIVDNGNGTYTF

SEQ ID NO: 37 - protein, 201 aa, Magnetospirillum magneticum AMB-1; identical to SEQ ID NO: 36

SEQ ID NO: 38 - protein, 190 aa, Magnetospirillum magneticum AMB-1
MTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTATQNVSVTITGSNDGPTVSGAVGLGHTAEDNSVTFTKAQLLANAHDTDAHDTLSVSNLSAAHGSIVDNGNGTYTF

SEQ ID NO: 39 - protein, 158 aa, Magnetospirillum magneticum AMB-1
DVISAGAGDDVIYGDARLVNGNIQITGSGNDVLDGGSGNDQIHGGAGNDTIIGGTGDDVMFGDQGNDTFLFDFGFGHDVVDGGRGSNWTDTLDLTHDNQISSVNIEGVSGWAVSVDAQGHHVAQATNGAHDANGTIVVTNHDGSQDTIEFHNVEKVVW

SEQ ID NO: 40 - protein, 666 aa, Magnetospirillum sp. SO-1
HRPVAGDDSRIDDDAQGPALSVSMGTTTVETTTTGTSADVDWNGLDTMSDPTTATPTTNVAGDLNTANNGSNNADVISIGGDNNASISTGNGDDQVTIGDDVNAKIDLGNGTNALDMADDVNASVSGGSGNDTVRVGDDLNGNIDLGNGDNRLQVGGDANASISTGSGSDDVKIVGDLNSNISLGSGADDLQTGGDANASIDVGEGNDRVLVGDDLSSKASLGSGDDYLEVADDSWASIDAGSGNDTVKIGGDISSKVDMGSGNDRVTITGDNLWATVTGGSGTDSIELTGVTKAEWDANANGVKNYVKDFENIKFADGQVIGDASAFDTTTTTSTYKTPLTIEATLNDTDGSETLSPVTIGNIPAGATLELDGEVLTPNADGTYTLNVMSGSPVEVTLVTDTPVTANSLNLTTTVSSTEAHGGDVSVTTQVGVGSNAGETVADDRIATDTNRTVSIDSADLLANDTDADGDALSIISVGNAQHGTVSLGADGQVVFTADRGFEGTTTFEYTVSDGHGGTDVATVSVYVDDPNDAPVINAAQTTETLSVDYSEPNSSNIGRVSATDVNGDTLTYSVLDSGNQHGNLVIDSDSGSFFYNADDTSWSGTDTFTVQVDDGNGGLATQTISVQVTGGSGGGNGSGGGHAIGWGNGGGRDESWGANGSWSV

SEQ ID NO: 41 - protein, 547 aa, Magnetospirillum sp. SO-1
SEDGSGSGSAVASDVDGDTLRYHLVDTDGNQVSSLSTDHGTVTIDSATGEYTFTPNAEAQALGVGAVQSDTFKVVATDGTTTSEPTTVGVTITGSNDGPIVSGAVDLGDTAEDNSITFTKAQLLANASDVDGDSLSVSNLTSANGTITENSDGTYTFTPAENFSGSVDVSYTVSDGQGGTTAGSASLDVSAVADQASVSLSIGEGAVDTNGSFTVTNHDGSAGYHNTYGYYVMDENGNPTSGEIIWKDVHDTNGQSVTIEGVDPDQVGFFIIPNGDQNSSIRDGSDVTFTKDSAGNWQVVDSNGAVLSGTGTKVLFDNKDLNSDDLVHMQDTSRDGGNQNWEDLNGGGDRDYNDLNMTVEWGEAEPTSTHEVNIAASFPDMDGSEGHTVVLNGLPEGATLYQDGVALVPGADGSYTLDASDLDGLTLTTAPGFSGEIELSVTATSADGASTASASAQAEVNIDLGNTGPDAGEAESVSTAVNNAVTGQVEATDADGNDLNFSLATGNDGPQHGSVALNPDGTFTYTPTGNFSGTDTFKVVIDDGHGG

SEQ ID NO: 42 - protein, 443 aa, Magnetospirillum sp. SO-1
EDGSGSGSAVASDVDGDTLRYHLVDTDGNQVSSLSTDHGTVTIDSATGEYTFTPNAEAQALGVGAVQSDTFKVVATDGTTTSEPTTVGVTITGSNDGPIVSGAVDLGDTAEDNSITFTKAQLLANASDVDGDSLSVSNLTSANGTITENSDGTYTFTPAENFSGSVDVSYTVSDGQGGTTAGSASLDVSAVADQASVSLSIGEGAVDTNGSFTVTNHDGSAGYHNTYGYYVMDENGNPTSGEIIWKDVHDTNGQSVTIEGVDPDQVGFFIIPNGDQNSSIRDGSDVTFTKDSAGNWQVVDSNGAVLSGTGTKVLFDNKDLNSDDLVHMQDTSRDGGNQNWEDLNGGGDRDYNDLNMTVEWGEAEPTSTHEVNIAASFPDMDGSEGHTVVLNGLPEGATLYQDGVALVPGADGSYTLDASDLDGLTLTTAPGFSGEIELSVTAT

SEQ ID NO: 43 - protein, 166 aa, Magnetospirillum sp. SO-1
VVSASDVLTSEDGSGSGSAVASDVDGDTLRYHLVDTDGNQVSSLSTDHGTVTIDSATGEYTFTPNAEAQALGVGAVQSDTFKVVATDGTTTSEPTTVGVTITGSNDGPIVSGAVDLGDTAEDNSITFTKAQLLANASDVDGDSLSVSNLTSANGTITENSDGTYTF

SEQ ID NO: 44 - protein, 153 aa, Magnetospirillum sp. SO-1
SGSAVASDVDGDTLRYHLVDTDGNQVSSLSTDHGTVTIDSATGEYTFTPNAEAQALGVGAVQSDTFKVVATDGTTTSEPTTVGVTITGSNDGPIVSGAVDLGDTAEDNSITFTKAQLLANASDVDGDSLSVSNLTSANGTITENSDGTYTFTP

SEQ ID NO: 45 - protein, 292 aa, Magnetospirillum sp. SO-1
PLTIEATLNDTDGSETLSPVTIGNIPAGATLELDGEVLTPNADGTYTLNVMSGSPVEVTLVTDTPVTANSLNLTTTVSSTEAHGGDVSVTTQVGVGSNAGETVADDRIATDTNRTVSIDSADLLANDTDADGDALSIISVGNAQHGTVSLGADGQVVFTADRGFEGTTTFEYTVSDGHGGTDVATVSVYVDDPNDAPVINAAQTTETLSVDYSEPNSSNIGRVSATDVNGDTLTYSVLDSGNQHGNLVIDSDSGSFFYNADDTSWSGTDTFTVQVDDGNGGLATQTISVQVT

SEQ ID NO: 46 - protein, 199 aa, Magnetospirillum sp. SO-1
TSTHEVNIAASFPDMDGSEGHTVVLNGLPEGATLYQDGVALVPGADGSYTLDASDLDGLTLTTAPGFSGEIELSVTATSADGASTASASAQAEVNIDLGNTGPDAGEAESVSTAVNNAVTGQVEATDADGNDLNFSLATGNDGPQHGSVALNPDGTFTYTPTGNFSGTDTFKVVIDDGHGGTTTETVSVTVENPNHRPV

SEQ ID NO: 47 - protein, 107 aa, Magnetospirillum sp. SO-1
SEPTTVGVTITGSNDGPIVSGAVDLGDTAEDNSITFTKAQLLANASDVDGDSLSVSNLTSANGTITENSDGTYTFTPAENFSGSVDVSYTVSDGQGGTTAGSASLDV

SEQ ID NO: 48 - protein, 156 aa, Magnetospirillum sp. SO-1
EDGSGSGSAVASDVDGDTLRYHLVDTDGNQVSSLSTDHGTVTIDSATGEYTFTPNAEAQALGVGAVQSDTFKVVATDGTTTSEPTTVGVTITGSNDGPIVSGAVDLGDTAEDNSITFTKAQLLANASDVDGDSLSVSNLTSANGTITENSDGTYTF

SEQ ID NO: 49 - protein, 156 aa, Magnetospirillum sp. SO-1; identical to SEQ ID NO: 48

SEQ ID NO: 50 - protein, 429 aa, Magnetospirillum magneticum AMB-1
  misc_feature (123)..(123): Xaa can be any naturally occurring amino acid
  misc_feature (392)..(392): Xaa can be any naturally occurring amino acid
MTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTTLEIPGTELEFVIMXLQVTARRHVHQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVTLEDPRYRARLYHXVDGDRHFLGVGAFGTGDREVLGHGIPAPRAWPAGFSL

SEQ ID NO: 51 - protein, 387 aa, Magnetospirillum magneticum AMB-1
  misc_feature (132)..(132): Xaa can be any naturally occurring amino acid
MQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTTLEIPGTELEFVIMXLQVTARRHVHQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDV

SEQ ID NO: 52 - protein, 438 aa, Magnetospirillum magneticum AMB-1
  misc_feature (132)..(132): Xaa can be any naturally occurring amino acid
  misc_feature (401)..(401): Xaa can be any naturally occurring amino acid
MQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTTLEIPGTELEFVIMXLQVTARRHVHQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVTLEDPRYRARLYHXVDGDRHFLGVGAFGTGDREVLGHGIPAPRAWPAGFSL

SEQ ID NO: 53 - protein, 366 aa, Magnetospirillum magneticum AMB-1
  misc_feature (132)..(132): Xaa can be any naturally occurring amino acid
MQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTTLEIPGTELEFVIMXLQVTARRHVHQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDI

SEQ ID NO: 54 - protein, 365 aa, Magnetospirillum magneticum AMB-1
  misc_feature (131)..(131): Xaa can be any naturally occurring amino acid
QALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTTLEIPGTELEFVIMXLQVTARRHVHQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDI

SEQ ID NO: 55 - protein, 315 aa, Magnetospirillum magneticum AMB-1
  misc_feature (60)..(60): Xaa can be any naturally occurring amino acid
QATSVETDQGTFTIGEDGKWSFALNNDDPAVQALGANDSMTKTFTTLEIPGTELEFVIMXLQVTARRHVHQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDV

SEQ ID NO: 56 - protein, 314 aa, Magnetospirillum magneticum AMB-1
  misc_feature (132)..(132): Xaa can be any naturally occurring amino acid
MQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTTLEIPGTELEFVIMXLQVTARRHVHQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSF

SEQ ID NO: 57 - protein, 386 aa, Magnetospirillum magneticum AMB-1
  misc_feature (132)..(132): Xaa can be any naturally occurring amino acid
MQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTTLEIPGTELEFVIMXLQVTARRHVHQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSD

SEQ ID NO: 58 - protein, 411 aa, Magnetospirillum magneticum AMB-1
VNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSND

SEQ ID NO: 59 - protein, 470 aa, Magnetospirillum magneticum AMB-1
IRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSNDSATISGDIAG

SEQ ID NO: 60 - protein, 468 aa, Magnetospirillum magneticum AMB-1
IRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSNDSATISGDI

SEQ ID NO: 61 - protein, 345 aa, Magnetospirillum magneticum AMB-1
LTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSNDSATISGDIAG

SEQ ID NO: 62 - protein, 371 aa, Magnetospirillum magneticum AMB-1
YGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSNDSATISGDI

SEQ ID NO: 63 - protein, 419 aa, Magnetospirillum magneticum AMB-1
LDDIRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSF

SEQ ID NO: 64 - protein, 280 aa, Magnetospirillum magneticum AMB-1
QATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSNDSATISGDIAG

SEQ ID NO: 65 - protein, 172 aa, Magnetospirillum magneticum AMB-1; identical to SEQ ID NO: 13

SEQ ID NO: 66 - protein, 387 aa, Magnetospirillum magneticum AMB-1
ANATDSDGDTLSILSLDDIRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGG

SEQ ID NO: 67 - protein, 182 aa, Magnetospirillum magneticum AMB-1
DHPLTMTAAEWQAKLLANATDSDGDTLSILSLDDIRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMNDSVQSLGAGDHLTRTFEVQTADGTSQTVTVTIDG

SEQ ID NO: 68 - protein, 93 aa, Magnetospirillum magneticum AMB-1
GDTLSILSLDDIRIDHGSFARNADGTYTFTPDANFNGEINATYTISDGHGGLATGSASLHVNAVNDAAEITGDTAVVVGEDTARAAGNLDATD

SEQ ID NO: 69 - protein, 411 aa, Magnetospirillum magnetotacticum
MNSDHLVHAEDSSAVSGNQNWEDLNGGGDRDYNDVNMSVSWGNAAPTASHALSVSASFPDMDGSESHTVSISGLPAGATLYQNGVALVAGADGSYSLNPAQLGGLSVKTPAGFTGDLNVNVTAVATDGTSVASSSASASVHDDLANHGPDAGDPTSVHGAAGATITSAVGVTDVDGDHLSYAVGTGNNGPQHGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTVSASNVTTANDHTAITGHASGADVDTGDTVAYHLVDGSGNQVDSLTTAHGTVTINSAT

SEQ ID NO: 70 - protein, 240 aa, Magnetospirillum magnetotacticum
TDVDGDHLSYAVGTGNNGPQHGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTVSASNVTTANDHTAITGHASGADVDTGDTVAYHLVDGSGNQVDSLTTAHGTVTINSAT

SEQ ID NO: 71 - protein, 127 aa, Magnetospirillum magnetotacticum
DHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTVSASNVTTANDHTAITGHASGADVDTG

SEQ ID NO: 72 - protein, 183 aa, Magnetospirillum magnetotacticum
TDVDGDHLSYAVGTGNNGPQHGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTV

SEQ ID NO: 73 - protein, 300 aa, Magnetospirillum magnetotacticum
LSVSASFPDMDGSESHTVSISGLPAGATLYQNGVALVAGADGSYSLNPAQLGGLSVKTPAGFTGDLNVNVTAVATDGTSVASSSASASVHDDLANHGPDAGDPTSVHGAAGATITSAVGVTDVDGDHLSYAVGTGNNGPQHGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDG

SEQ ID NO: 74 - protein, 88 aa, Magnetospirillum magnetotacticum
FKVVATDSHGADSNVGTVNVTVTGSNDGPTVSASNVTTANDHTAITGHASGADVDTGDTVAYHLVDGSGNQVDSLTTAHGTVTINSAT

SEQ ID NO: 75 - protein, 89 aa, Magnetospirillum magnetotacticum
VSWGNAAPTASHALSVSASFPDMDGSESHTVSISGLPAGATLYQNGVALVAGADGSYSLNPAQLGGLSVKTPAGFTGDLNVNVTAVATD

SEQ ID NO: 76 - protein, 86 aa, Magnetospirillum magnetotacticum
GGGDRDYNDVNMSVSWGNAAPTASHALSVSASFPDMDGSESHTVSISGLPAGATLYQNGVALVAGADGSYSLNPAQLGGLSVKTPA

SEQ ID NO: 77 - protein, 189 aa, Magnetospirillum magnetotacticum
TDVDGDHLSYAVGTGNNGPQHGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTVSASNVT

SEQ ID NO: 78 - protein, 166 aa, Magnetospirillum magnetotacticum
HGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTVSAS

SEQ ID NO: 79 - protein, 405 aa, Magnetospirillum magneticum AMB-1
MTKTFTVASADGTATQEVTVTINGANDSATISGSTTGAVAEDGNGRATGTLSVADVDHGQAHVTAQTVQTDQGTFSIGENGQWTFQVNSANADVQALGAGESMTKTFAVASADGTATQNVTVTINGANDSATISGSTTGAVAEDGNGRATGTLNVADVDHGQAHVTAQTVQTDQGTFSIGENGQWTFQVNSGNADVQALGAGDSMTKTFTVTSADCTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGGVGEDGTQAATGTLNVSDVDSGEAHVQATSVETDQGTFTIGEDGKWSFALNNDDPAVQALGA

SEQ ID NO: 80 - protein, 405 aa, Magnetospirillum magnetotacticum; identical to SEQ ID NO: 79

SEQ ID NO: 81 - protein, 343 aa, Magnetospirillum magneticum AMB-1
TKTFTVASADGTATQEVTVTINGANDSATISGSTTGAVAEDGNGRATGTLSVADVDHGQAHVTAQTVQTDQGTFSIGENGQWTFQVNSANADVQALGAGESMTKTFAVASADGTATQNVTVTINGANDSATISGSTTGAVAEDGNGRATGTLNVADVDHGQAHVTAQTVQTDQGTFSIGENGQWTFQVNSGNADVQALGAGDSMTKTFTVTSADCTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGG

SEQ ID NO: 82 - protein, 396 aa, Magnetospirillum magneticum AMB-1
MTKTFTVASADGTATQEVTVTINGANDSATISGSTTGAVAEDGNGRATGTLSVADVDHGQAHVTAQTVQTDQGTFSIGENGQWTFQVNSANADVQALGAGESMTKTFAVASADGTATQNVTVTINGANDSATISGSTTGAVAEDGNGRATGTLNVADVDHGQAHVTAQTVQTDQGTFSIGENGQWTFQVNSGNADVQALGAGDSMTKTFTVTSADCTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGGVGEDGTQAATGTLNVSDVDSGEAHVQATSVETDQGTFTIGEDGKWSFALNND

SEQ ID NO: 83 - protein, 289 aa, Magnetospirillum magneticum AMB-1
MTKTFTVASADGTATQEVTVTINGANDSATISGSTTGAVAEDGNGRATGTLSVADVDHGQAHVTAQTVQTDQGTFSIGENGQWTFQVNSANADVQALGAGESMTKTFAVASADGTATQNVTVTINGANDSATISGSTTGAVAEDGNGRATGTLNVADVDHGQAHVTAQTVQTDQGTFSIGENGQWTFQVNSGNADVQALGAGDSMTKTFTVTSADCTDTQEVTVTIHGSNDSATISGDIAGGVGEDGTGTATGTLNVADVDNGEAHVQATSVETDQGTFTIGEDGKWSF

SEQ ID NO: 84 - protein, 342 aa, Magnetospirillum magneticum AMB-1
TVQTDQGTFSIGENGQWTFQVNSANADVQALGAGESMTKTFAVASADGTATQNVTVTINGANDSATISGSTTGAVAEDGNGRATGTLNVADVDHGQAHVTAQTVQTDQGTFSIGENGQWTFQVNSGNADVQALGAGDSMTKTFTVTSADCTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGGVGEDGTQAATGTLNVSDVDSGEAHVQATSVETDQGTFTIGEDGKWSFALNNDDPAVQALGASYS

SEQ ID NO: 85 - protein, 396 aa, Magnetospirillum magneticum AMB-1; identical to SEQ ID NO: 82

SEQ ID NO: 86 - protein, 343 aa, Magnetospirillum magneticum AMB-1; identical to SEQ ID NO: 81

SEQ ID NO: 87 - protein, 1103 aa, Magnetospirillum magnetotacticum
MQALGANDHLTKTFEVQTADGTTQTVTVTVDGANDAAVITGDTRGGVGEDGVLKTSGDLNATDVDSAATFQESSVTDAHGTFTVGTDGAWSYTLNNDSPAVQALGANDHLTKTFEVQTADGTTQTVTVTVDGANDAAVITGDTRGGVGEDGVLNTSGDLNATDVDSATSFQESSVTDAHGTFTVGTDGAWSYTLNNDSPAVQALGANDHLTKTFEVQTADGTTQTVTVTVDGANDAAVITGDTRGGVGEDGVLKTSGDLNATDVDSAATFQESSVTDAHGTFTVGTDGAWSYTLNNDSPAVQALGANDHLTKTFEVQTADGTTQTVTVTVDGANDAAVITGDTRGGVGEDGVLNTSGDLNATDVDSATSFQESSVTDAHGTFTVGTDGAWSYTLNNDSPAVQALGANDHLTKTFEVQTADGTTQTVTVTVDGANDGPTTGAVTLAAGTEDNSVTIRASDLLSQAHDIEGDTLSVTNLHANNGSITDNHDGTYTFTPNHDFNGQVDLSYTISDGHGGNTEGSAKFDVTAVNDGPVVSGDVTLTSGTEDRSVTIKAGDLLGHASDVDGDTLSVSNLSASNGTITDNHDGTYTFTPNQDFNGHVDLTYTVADGHGGEAPGKAGFEVSAVADDARIVAPDVSITYGSANTSQTLAGTAGADTLVGGGGNDTLTGGAGNDVLYGDAGPNSGGPFNVALNIDASATVNGEHVGTITLTGLPDGANLSAGVHNADGSWTLSAGDLHGLTANVADATPFNVGIAVQTVDGTSTHVTTSSMSVDFHSTTVDGNDTISGGAGSDTMYGGGGNDTFLISDNDGSTDTFIGGDGTDTIMGNWSYDTLKVDNHLANLQGIEVIDGGDGTPAYNTIQAGSGNDELDFSGMTVKSFVIDGGAGNDTITGTSGNDTISGGAGSDTMSGGAGNDTFLISNNDGSTDTFIGGDGTDTIMGNWSYDTLKVDNHLANLQGIEVIDGGDGTPAYNTIQGGSGNDELDFSGMTVKSFVIDGGAGNDTITGTSGNDTISGGAGSDTMSGGAGNDTFLISNNDGSTDTFIGGDGTDTIMGNWSYDTLKVDNHLANLQGIEVIDGGDGTPAYNTIQGGSGNDELDFSG

SEQ ID NO: 88 - protein, 587 aa, Magnetospirillum magnetotacticum
LTKTFEVQTADGTTQTVTVTVDGANDAAVITGDTRGGVGEDGVLKTSGDLNATDVDSAATFQESSVTDAHGTFTVGTDGAWSYTLNNDSPAVQALGANDHLTKTFEVQTADGTTQTVTVTVDGANDAAVITGDTRGGVGEDGVLNTSGDLNATDVDSATSFQESSVTDAHGTFTVGTDGAWSYTLNNDSPAVQALGANDHLTKTFEVQTADGTTQTVTVTVDGANDAAVITGDTRGGVGEDGVLKTSGDLNATDVDSAATFQESSVTDAHGTFTVGTDGAWSYTLNNDSPAVQALGANDHLTKTFEVQTADGTTQTVTVTVDGANDAAVITGDTRGGVGEDGVLNTSGDLNATDVDSATSFQESSVTDAHGTFTVGTDGAWSYTLNNDSPAVQALGANDHLTKTFEVQTADGTTQTVTVTVDGANDGPTTGAVTLAAGTEDNSVTIRASDLLSQAHDIEGDTLSVTNLHANNGSITDNHDGTYTFTPNHDFNGQVDLSYTISDGHGGNTEGSAKFDVTAVNDGPVVSGDVTLTSGTEDRSVTIKAGDLLGHASDVDGDTLSVSNLSASNGTITDNHDGTYTFTPNQD

SEQ ID NO: 89 - protein, 255 aa, Magnetospirillum magnetotacticum
QTFTFNTLGGLKVDNFEALKVNLNGHDISLENPPEVTAATAVTTDEDHSSTGHVTATDQDVGDSVRYHLMDANGNQVDSLTTAHGTVTINSATGDYTFTPNADAQALRAGDVQTDSFKVVATDGTMTSAPSTVGVTINGANDSATITGTAAGAVGEDGNGRATGTLSVADVDSGQAHVTAQTVQTDQGTFSIGENGQWSFQVNSSNADVQALGAGESMTKTFAVASADGTATQNVSVTITGSNDGPTVSGAVALG

SEQ ID NO: 90 - protein, 325 aa, Magnetospirillum magnetotacticum
DISLENPPEVTAATAVTTDEDHSSTGHVTATDQDVGDSVRYHLMDANGNQVDSLTTAHGTVTINSATGDYTFTPNADAQALRAGDVQTDSFKVVATDGTMTSAPSTVGVTINGANDSATITGTAAGAVGEDGNGRATGTLSVADVDSGQAHVTAQTVQTDQGTFSIGENGQWSFQVNSSNADVQALGAGESMTKTFAVASADGTATQNVSVTITGSNDGPTVSGAVALGHTAEDNSVTFTKAQLLANAHDVDTHDTLSVSNLTSTHGSIVDNGNGTYTFTPTENYSGHVDVSYTVSDGHGGTAAGSAALDVDAVADRASVSVSIG

SEQ ID NO: 91 - protein, 294 aa, Magnetospirillum magnetotacticum
TFTFNTLGGLKVDNFEALKVNLNGHDISLENPPEVTAATAVTTDEDHSSTGHVTATDQDVGDSVRYHLMDANGNQVDSLTTAHGTVTINSATGDYTFTPNADAQALRAGDVQTDSFKVVATDGTMTSAPSTVGVTINGANDSATITGTAAGAVGEDGNGRATGTLSVADVDSGQAHVTAQTVQTDQGTFSIGENGQWSFQVNSSNADVQALGAGESMTKTFAVASADGTATQNVSVTITGSNDGPTVSGAVALGHTAEDNSVTFTKAQLLANAHDVDTHDTLSVSNLTSTHGSI

SEQ ID NO: 92 - protein, 180 aa, Magnetospirillum magnetotacticum
DTFIGGDGTDTIMGNWSYDTLKVDNHLANLQGIEVIDGGDGTPAYNTIQGGSGNDELDFSGMTVKSFVIDGGAGNDTITGTSGNDTISGGAGSDTMSGGAGNDTFLISNNDGSTDTFIGGDGTDTIMGNWSYDTLKVDNHLANLQGIEVIDGGDGTPAYNTIQGGSGNDELDFSGMTVKS

SEQ ID NO: 93 - protein, 180 aa, Magnetospirillum magnetotacticum; identical to SEQ ID NO: 92

SEQ ID NO: 94 - protein, 137 aa, Magnetospirillum magnetotacticum
DTFIGGDGTDTIMGNWSYDTLKVDNHLANLQGIEVIDGGDGTPAYNTIQGGSGNDELDFSGMTVKSFVIDGGAGNDTITGTSGNDTISGGAGSDTMSGGAGNDTFLISNNDGSTDTFIGGDGTDTIMGNWSYDTLKV

SEQ ID NO: 95 - protein, 180 aa, Magnetospirillum magnetotacticum
DTFIGGDGTDTIMGNWSYDTLKVDNHLANLQGIEVIDGGDGTPAYNTIQAGSGNDELDFSGMTVKSFVIDGGAGNDTITGTSGNDTISGGAGSDTMSGGAGNDTFLISNNDGSTDTFIGGDGTDTIMGNWSYDTLKVDNHLANLQGIEVIDGGDGTPAYNTIQGGSGNDELDFSGMTVKS

SEQ ID NO: 96 - protein, 115 aa, Magnetospirillum magnetotacticum
DTFIGGDGTDTIMGNWSYDTLKVDNHLANLQGIEVIDGGDGTTSYNTIQAGSGNDELDFSGMTVKNFVIDGGAGNDTITGTAGADTIQAGTGNDTVIANQGSVGSDVYHGGAGTD

SEQ ID NO: 97 - protein, 104 aa, Magnetospirillum magnetotacticum
NVSVTITGSNDGPTVSGAVALGHTAEDNSVTFTKAQLLANAHDVDTHDTLSVSNLTSTHGSIVDNGNGTYTFTPTENYSGHVDVSYTVSDGHGGTAAGSAALDV

SEQ ID NO: 98 - protein, 909 aa, Magnetospirillum gryphiswaldense MSR-1
DIALGDSLTYGLTFLDADGNVIPTPDWVEFDAATGQLSGTPDNSDVGAFQIQVTATDESGATATTEPFTVSVADVDNAAEISVTGGEGDESTTNAATVVTGQIEASDADGGIVSFAVVAGGDHHGSLTVNADGSFSFTAEDANWNGTDSFQVQLTDGEGNVYTQSLTITVDPTNDAPVVTMGVDLGTGTEDQRIIISKSDLVENASDVDGDALAAANISADHGTIIDNGNGTITFVPDANYNGDVTFSYTVSDGQGGTASGTATLDVTAVNDGPVVSGTVDLGDSLEDQAVIISKEDLLGNASDVDGDTLSAANISADHGTIVDNGDGTITFTPAADYHGDVTFTYTVSDGQGGTTSGTATLDLADVSDNQGPVAGDDGDNIDMSAQGPALRLNIGDATVIEGENPMAGLADMEDPTSRATTTNYGSDLNSSLTNNGNVDDLVSVGRDVNASINIGNGDDQLSVGRDVNANVDLGNGTNALDVGGDVNASVTTGSGNDTVRIGDELNGRIDLGNGDNRLEIGGAANASITTGSGADEVKVGGNLNSQATLGSGDDTLDIDGSAYATIDAGSGNDIVTIGNDVSSNITLGAGDDILQVTDDVWATIDAGSGDDTVSLGGDISGKVDMGSGNDHLTITGQNLWSTVTGGSGTDSIELTGVTKAQWDANTNNIQGYVKDFENIKFSDGRVIGDASAFEGNGGGESDTYEYPIEVTATLTDTDGSESLSAVTLTNIPAGATVMLGDQVLTAGNDGSYSVNVTSGSTVTLTVVSDGPLDLSGVTASVTSTEANGGDTATTTLVGEGSNAGEAAQEGIHVAEDGSIVINGSNLLANDSDADGDTLTIVSVGDAEHGSVTLNPDGTISFVPDANYQGETSFTYTVSDGQGGTSTATVNLTVDSDGINENVSYTIDA

SEQ ID NO: 99 - protein, 306 aa, Magnetospirillum gryphiswaldense MSR-1
NDTMFGGSGNDVISGGGGNDKLYGDGATEGSGGYLYADLDISGGASDGSSVTYTIAGLEAGVQLVQDGVVLSADANGVYTLDDVAGLELKIPDNGSLTDIDFTVGLLDANGQQVASDTVTMDVSDFAGLGSGDGNDTLSGGSGTDTLFGGGGDDVLVYSADQVSDRNDADYQDQGGAARDGTDHTVDSNGLNDTLDTYIGGSGHDTLTMSDGNDAIWIGNVQGVEVIQAGAGNDVVDMNYSDGTSYGDLTVDGGSGNDAIFTNDGDDVLIGGSGTNYLSGNAGNDTFIGGSGSDAMHGGAGADTVD

SEQ ID NO: 100 - protein, 123 aa, Magnetospirillum gryphiswaldense MSR-1
TVDGGAGNDTIWTGNGDDTLIGGAGDDQLYGEAGSDTFLFDFGSGHDTVNGGGGSWTDTLDFSDAVGQTFVITTDSGESWTIQVDGENHGTLDIGDNASGEVHLNTANGETVVDFDNIEQIKW

SEQ ID NO: 101 - protein, 745 aa, Magnetospirillum gryphiswaldense MSR-1
SDTVTYTVTSADGSTLTNTMNLNVANVDDAPQVTLAGGSGDEDTVITGSIGVADVDNQGAASTLELVGDAQHGTVTLNSNGTYSFVASDANWNGTDTFTVRITDAQGAVTEQVVEVNVGAVDDATMVSAPVDLGAVTEDSGTITIAASDLLANASDVDNALSVDNVKINGVELVDNGDGTYSYTPPADFNGQIDVTYDVVTDTGIATPATASIDVTAVDDATVVSAPVDLGDVTEDSGTITIAASDLLANASDVDNALSVDNVKINGVELVDNGDGTYSYTPPANFNGQIDVTYDVVTDTGIATPATASIDVTAVDDATMVSAPVDLGAVDEDSGVITIAASDLLANASDVDNALSVDNVKINGVELVDNGDGTYSYTPPADFNGTIDVTYDVVTDTGIATPATASIDVNAVEDAAQLDSPSEVDLTVGQDGIGTGDLDASDADGDTLTYGIVDPATGELVGQLETDYGTVVVDPATGEYTFTPNDNAATLDDNQSASDAFQVAASDGTSISEPQNVSVTITGSNDGPVVETTTSSLTMSEDGSAEGAIAGSDVDAGDTVSYYLVDENGDRVTTLVTDNGSVTIDSETGQYTFTAADGLNSLNDGDSVTDSFQVVAWDGTAASAPQDVSVTINGSDDATVVTGSVDLGDVTEDTGVITISAEDLLANASDVDNALSVDNVKINGVELVDNGDGTYSYTPPADFNGTIDVTYDVVTDTGIATPATASIDVTAVDDATVVSAPVDLG

SEQ ID NO: 102 - protein, 387 aa, Magnetospirillum gryphiswaldense MSR-1
TDSFTVFVTDDEGNTVSQVVELNIANVDDAAVVSVTGGVGDESTTGDATTVTGSISATDVDGAIIGYEVVAGDHPGSLTVNADGTFTFVADNPNWNGSETFTVKVYDDQGGATEVPVTITVNATDDAVVDNGILIDLPGDNDPTLVAVPNPVEMQEDSSLRFAIDATDPDGSPVTISFEQPAHGSVIDNGDGTFTYQPSDNYFGSDTVTYTVTSADGSTLTNTMNLNVANVDDAPQVTLAGGSGDEDTVITGSIGVADVDNQGAASTLELVGDAQHGTVTLNSNGTYSFVASDANWNGTDTFTVRITDAQGAVTEQVVEVNVGAVDDATMVSAPVDLGAVTEDSGTITIAASDLLANASDVDNALSVDNVKINGVELVDNGDGTYSY

SEQ ID NO: 103 - protein, 54 aa, Magnetospirillum gryphiswaldense MSR-1
TFDNTEVSSVVKSDTVDGGAGNDTIWTGNGDDTLIGGAGDDQLYGEAGSDTFLF

SEQ ID NO: 104 - protein, 1857 aa, Magnetospirillum magneticum AMB-1
MPTCRPLGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTATQNVSVTITGSNDGPTVSGAVGLGHTAEDNSVTFTKAQLLANAHDTDAHDTLSVSNLSAAHGSIVDNGNGTYTFTPTETFSGHVDVSYTVSDGHGGTTTGSAALDVDAVADRATVSVAIGAPVETPNGSFTVTNLDSTASAGYNNTYGYYVMDDSGNPTSGGVIWSNVHASPGASVTISGVDPDRVGFFLIPDGGSQNSGLANGAALTFSKDASGNWQASDSAGHVLSGAGTKVLFDKSALNGDHMVHSEDTSAVSGNQNWEDLTGGGDRDYNDVNMSVTWGNAAPTATHPLTVSASFPDMDGSEGHAVKISGLPSGSTLYQNGVALVAGADGSYSLNPAQLGGLSVKTPAGFNGDLNVNVTAVATDGTSVASSTASATVHDDLSNHGPDAGDATSVHGAMGATITGAAGVTDSDGDHLSYAVGTGTSGPQHGTVVVNTDGTFTYTPSGNYSGTDTFKITVSDGHGGTATETVNVTVENGAPTLTTANAATANDHSAVTGHVTGSDTPGDTLSYSLVDANGNHVGSLVTDHGTVSINAATGDYTFTPNAANASLGVGASVTDSFKVVATDNHGADSNLGTVAVTVTGSNDGPVVTGVTGGTGNESITSARSVVTGHISAGDVDAGDTLSYSVTDNAAAGHHGTLAVNASGDYTFTASDSNWHGTDSFTVQVSDGHGGTVNQTVAITVNAQADAATINAQDASMAAQSGATFTASGGYAEGGSGSDIINGSSANDILYGDDPSGDTEVTVALNISAAAISGESVSSITLSNLPGGAVLNHGHDNGDGTWTLAPGDLTGLTLTSNNGIGGTVDVAVTTLDGTSTAVTNSSFNVSFSGGFNDTITGGVGADTMYGGAGNDTFKVSGASESTGDIYDGGSGTDTVLGSSGNDVISVTSNLGNMRSIEVIDGGAGTDTLLAGSGNDYLDFSGTTIRGVEVIDTGAGNDVITGSAGADTILTGTGDDTVVAIGGQTAGDVYDGGAGTDTLNVDLTPAQYTTAVRLELMSFASFVDNPANAGKSFTFQSLGGLKATNFEDLRVTVDGNDVDLNHPPQVTSVESNYTAGHADGVVHATDSDGDTMSYSFGTNTNGTPITSMATAHGTVTIDSSTGEYHFTASDANFKGTDTFSVTVKDGMGGTTTQKVNLDFNPGDDATVVTGPTSLGGSDEDTQTFIRTDQLLANATDVDNTLHVANLSAVDSHGAVVGSFVHAVDADGHDGYAFTPNANFAGDVTVNYDVVTDTGIATHTSGSLHVDAVADAATFDATIGSNGVSVAHLGNDSKVVNLFVNDTSSGTAGFDIYLGGTNIGHYTVGRSYSSDKSVSLTLTDAQHTQLLNGADIKIVDNDGYNTRDVLVDRIQVDGLTFQAENGILSGASTTSGYYGVSSETYARLNNVGSSVTFDFDSSVSHTSSGYHVDLAGHLNDTDGSETLSYHIDAMTTGASLSYTGNEGTLVHNTDGSWDFNVDASHYDGAVSLNLNVANGTAGFDVHVTANATETSNLDVAGVGDTVHCDGAIGGAGAIPGITLVGNAGNDDIIGTNGNDLLLGGKGGATYRFSGGGCGSGGGWSIVQSDTNDVISAGAGDDVIYGDARLVNGNIQITGSGNDVLDGGSGNDQIHGGAGNDTIIGGTGDDVMFGDQGNDTFLFDFGFGHDVVDGGRGSNWTDTLDLTHDNQISSVNIEGVSGWAVSVDAQGHHVAQATNGAHDANGTIVVTNHDGSQDTIEFHNVEKVVW

SEQ ID NO: 105 - protein, 1439 aa, Magnetospirillum magnetotacticum
HLVDGSGNQVDSLTTAHGTVSINTATGDYTFTPTGDSSLGVGQTLGDSFKVVAVDNHGAASAPSTVAVTITGSNDGPTVSVANVTTANDHTAITGHASGADVDTGDTVAYHLVDGNGNQVDSLTTAHGTVTINSATGDYTFTPTGDASVGVGQTLGDSFKVVAVDNHGAASAPSTVAVTITGSNDGPTVSVANVTTANDHTAITGHATGADVDTGDTVRYHLMDASGNQVDSLTTAHGTVTINAATGDYTFTPTGDSSLGVGQTLGDSFKVVAVDNHGSASAASTVNVTITGSNDGPVVSSVTGGTGNESTTSANSVVTGHITASDVDATDTLSYSVTDNAAAGHHGTLAVNASGDFTFTASDSNWHGTDSFTVQVSDGHGGTVNQSVGITVNAQADAATINAQDASMSAQSGATYTASDGYAQGGSGSDIINGSTANDTLYGDDPTGDTSVTVNLNISASAITGESVGSITLSNIPGGATLNHGVDNGDGTWTLAPADLTGLQLTSPTGMGGSINVAVTTLDGTSTAVTNSSFNVSFSGGFNDTITGGAGADTMYGGAGNDTFKVSGATESVGDIYDGGSGVDTILGSSGADVISVTSNLGNMHSIEVIDGGAGTDTLLAGSGNDYLDFSNTTIRNVEVIDTGAGNDVITGSAGADTILTGTGDDTVVAIGGQTTGDVYDGGAGFDTLNVDLTPAQYTHAVRLELMNFASFVDDPANAGKSFTFQSLGGLKATNFEDLRVTVDGNDVDLNHPPQVTSVESNYTTGHADGAVHVTDSDGDTLSYSLGTNANGSPITSMATAHGTVSIDAATGEYHFTSSDPNFKGTDSFNVTVNDGMGGTTTQKVNLDFNPGDDATVVTGPTALGTSTEDAQTFIRTDQLLANSTDVDNTLHVANLSAVDTNGNVVGSFVHAVDADGHDGYAFTPNANWSGDVTVNYDVVTDTGIATHTSGALHVDAVADAATFDANIGSNGVSVAHLGNDSKAINLYVNDSSSNSTAAGFDVYLGGTNLGHYTVNRSTTSDKTVSLTLTDAQHDQLLNGADIKIVDNDGSNSRDVLVDRIQVDGLTFQAENGIMVGAVSSHGTSGVTSETYARLNSIGSSVTFDLDTSVTHTASGYHVDLGGHLNDTDGSETLSYHIDALATGASLSYTGNEGTLVHNTDGSWDFNVDSSHYDGAASLNLNVAQGTTGFDVHITANATETSNLDVAGVGDVVHCDGAIGGGSAIPGITLVGNSGNDDLFGTDGNDLLLGGKGGYTYRYSGGSHGGNVGGCGYSLVDNGTNDVISAGAGDDIIYGDAKMVNGSIQVTGAGNDILDGGAGNDQIHGGGGNDTITGGTGDDVMFGDQGSDTFLFDFGFGHDVVDGGRGSNWTDTLDLTHDNQISAVNIEGVSGWAVSVDAQGHHVAQATNGAHDASGTVIVTNHDGSQDTIEFHNVEKVVW

SEQ ID NO: 106 - protein, 837 aa, Magnetospirillum magnetotacticum
VQALGAGESMTKTFTVASADGTATQEVTVTINGANDSATITGSAAGSVGEDGNHSATGHLSVADVDSGQAHVTAQTVETDQGTFSIGTDGNWSFAVNSANADVQALGAGESMTKTFAVASADGTATQNVSVTITGSNDGPTVSGAVALGHTAEDNSVTFTTAQLLANAHDVDTHDTLSVSNLTSTHGSIVDNGNGTYTFTPTENYSGHVDVSYTVSDGHGGTAAGSAALDVDAVADRASVSVSIGAAVETPNGSFTVTNLDSTASAGYHNTYGYYVMDDNGNPTSGGVIWSDVHASPNASVTVNGVDPDRVGFFIIPDGGSQNSGLANGAALTFSKDSAGNWQASDSAGHVLSGADSKVLFDNKALNSDHLVHAEDSSAVSGNQNWEDLTGGGDRDYNDVNMSVSWGNAAPTASHALSVSASFPDMDGSESHTVSISGLPAGATLYQNGVALVAGADGSYSLNPAQLGGLSVKTPAGFTGDLNVNVTAVATDGTSVASSSASASVHDDLANHGPDAGDPTSVHGAAGATITSAVGVTDVDGDHLSYAVGTGNNGPQHGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTVSASNVTTANDHTAITGHASGADVDTGDTVAYHLVDGSGNQVDSLTTAHGTVTINSATGDYTFTPTGDASVGVGQTLGDSFKVVVVDNHGAASAPSTVAVTITGSNDGPTVSVANVTTA

SEQ ID NO: 107 - protein, 145 aa, Magnetospirillum magnetotacticum
VQALGAGESMTKTFTVASADGTATQEVTVTINGANDSATITGSAAGSVGEDGNHSATGHLSVADVDSGQAHVTAQTVETDQGTFSIGTDGNWSFAVNSANADVQALGANESMTKTFTVASADGTATQEVTVTINGANDSATITGS

SEQ ID NO: 108 - protein, 148 aa, Magnetospirillum magnetotacticum
AQHLGAGVVQADSFQVVASDGSLSSAPTTVNVSITGNNDAATITGSAAGSVGEDGNHSATGHLSVADVDSGQAHVTAQTVETDQGTFSIGTDGNWSFAVNSANADVQALGAGESMTKTFTVASADGTATQEVTVTINGANDSATITGS

SEQ ID NO: 109 - protein, 167 aa, Magnetospirillum magnetotacticum
SLTTEHGTVTIDAKTGEYTFTPNDEADKLGVSQSAHDSFSVMVDDGHGGTSTANIGVTITGSNDGPTVSADAVLTGGDEDTSITIHASDLLKNAHDVDVGDTLSVTNLSATNGTITDNHDGTYTFTPNHDFNGQVDLSYTVSDGHGGDTPAKASFDVAAVNDKATLA

SEQ ID NO: 110 - protein, 830 aa, Magnetospirillum magneticum AMB-1
VQALGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTATQNVSVTITGSNDGPTVSGAVGLGHTAEDNSVTFTKAQLLANAHDTDAHDTLSVSNLSAAHGSIVDNGNGTYTFTPTETFSGHVDVSYTVSDGHGGTTTGSAALDVDAVADRATVSVAIGAPVETPNGSFTVTNLDSTASAGYNNTYGYYVMDDSGNPTSGGVIWSNVHASPGASVTISGVDPDRVGFFLIPDGGSQNSGLANGAALTFSKDASGNWQASDSAGHVLSGAGTKVLFDKSALNGDHMVHSEDTSAVSGNQNWEDLTGGGDRDYNDVNMSVTWGNAAPTATHPLTVSASFPDMDGSEGHAVKISGLPSGSTLYQNGVALVAGADGSYSLNPAQLGGLSVKTPAGFNGDLNVNVTAVATDGTSVASSTASATVHDDLSNHGPDAGDATSVHGAMGATITGAAGVTDSDGDHLSYAVGTGTSGPQHGTVVVNTDGTFTYTPSGNYSGTDTFKITVSDGHGGTATETVNVTVENGAPTLTTANAATANDHSAVTGHVTGSDTPGDTLSYSLVDANGNHVGSLVTDHGTVSINAATGDYTFTPNAANASLGVGASVTDSFKVVATDNHGADSNLGTVAVTVTGSNDGPVVNTANVTTANDHTAVSGHAAGTDVDAGDSVRYHLVDASGNQVDSLTTAHGTVSINAATGDYTFTPTGDSSLGVGQTLGDSFKVVAVDNHGAASAPSTVAVTITGSNDGPVVD

SEQ ID NO: 111 - protein, 242 aa, Magnetospirillum magneticum AMB-1
PAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGANESMTKTFTVTSADGTDTQEVTVTINGSNDGPVVSGPVDLGATAEDHSITFTAQQLLGHASDIDGDSLSVSNLSAGNGTISQNADGSYTFTPNADFNGEVNVTYTVSDGHGGTTSGSASFDVTSVNDGPTTS

SEQ ID NO: 112 - protein, 198 aa, Magnetospirillum magneticum AMB-1
PAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTASGTLNVSDVDNGEAHVQATSVETDQGTFTIGEDGKWSF

SEQ ID NO: 113 - protein, 198 aa, Magnetospirillum magneticum AMB-1
PAVQALGANDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSF

SEQ ID NO: 114 - protein, 200 aa, Magnetospirillum magneticum AMB-1
SGGDTLIGAAGNDYMSLEGGDHAQKISGIDHIQLGDGDNVILDMTTTRYDYGDLTVAGGSGHDVIWSASGDDLLVAGNGGNTIHGGAGNDTIVAGAGSDELMGQEGNDTFLFDFGSGHDTVNGGAGTNWTDTIDLSTDMHAGANITITTADNHSWTVASDGDHNATGNIELGQDKSGTITVHSQDGDQTIEFTNIESIKY

SEQ ID NO: 115 - protein, 85 aa, Magnetospirillum magneticum AMB-1
MTKTFTVTSADGTDTQEVTVTINGSNDSATISGDIAGGVGEDGTQAATGTLNVADVDSGEAHVQATSVETDQGTFTIGEDGKWSF

SEQ ID NO: 116 - protein, 547 aa, Magnetospirillum sp. SO-1; identical to SEQ ID NO: 41

SEQ ID NO: 117 - protein, 210 aa, Magnetospirillum sp. SO-1
SGSAVASDVDGDTLRYHLVDTDGNQVSSLSTDHGTVTIDSATGEYTFTPNAEAQALGVGAVQSDTFKVVATDGTTTSEPTTVGVTITGSNDGPIVSGAVDLGDTAEDNSITFTKAQLLANASDVDGDSLSVSNLTSANGTITENSDGTYTFTPAENFSGSVDVSYTVSDGQGGTTAGSASLDVSAVADQASVSLSIGEGAVDTNGSFTVT

SEQ ID NO: 118 - protein, 168 aa, Magnetospirillum sp. SO-1
DHIQLGDGDNVILDMTTSRYDYGDLTVAGGTGHDVIWSASGDDLLVAGDGGNTIHGGAGDDTIVAGAGSDDLMGQDGSDLFLFDFGTGHDTVNGGAGGNWTDTIDLSTNMGEGASITISTGGSDWTVASDGDHDAAGTINLGQDKSGTITVHSQDGDQTIEFTNIESI

SEQ ID NO: 119 - protein, 410 aa, Magnetospirillum magnetotacticum
MNSDHLVHAEDSSAVSGNQNWEDLNGGGDRDYNDVNMSVSWGNAAPTASHALSVSASFPDMDGSESHTVSISGLPAGATLYQNGVALVAGADGSYSLNPAQLGGLSVKTPAGFTGDLNVNVTAVATDGTSVASSSASASVHDDLANHGPDAGDPTSVHGAAGATITSAVGVTDVDGDHLSYAVGTGNNGPQHGTVVVNTDGTFSYTPTGNYSGTDTFKVTVSDGHGGTTTETVNVTVENGAPTLTTANATTANDHSAVTGHVTGTDSPGDTLSYSLVDANGNHVSSLVTDHGTVSINSATGDYTFTPKAGDASLGVGASATDSFKVVATDSHGADSNVGTVNVTVTGSNDGPTVSASNVTTANDHTAITGHASGADVDTGDTVAYHLVDGSGNQVDSLTTAHGTVTINSA

SEQ ID NO: 120 - protein, 154 aa, Magnetospirillum magnetotacticum
VTGHVTGTDSPGDTLSYSLVDANGNHVSSLVTDHGTVSINSATGDYTFTPKAGDASLGVGASATDSFKVVATDSHGADSNVGTVNVTVTGSNDGPTVSASNVTTANDHTAITGHASGADVDTGDTVAYHLVDGSGNQVDSLTTAHGTVTINSAT

SEQ ID NO: 121 - protein, 68 aa, Magnetospirillum magnetotacticum
AAGATITSAVGVTDVDGDHLSYAVGTGNNGPQHGTVVVNTDGTFSYTPTGNYSGTDTFKVTVSDGHGG

SEQ ID NO: 122 - protein, 56 aa, Magnetospirillum magnetotacticum
TDVDGDHLSYAVGTGNNGPQHGTVVVNTDGTFSYTPTGNYSGTDTFKVTVSDGHGG

SEQ ID NO: 123 - protein, 1352 aa, Magnetospirillum magneticum AMB-1
MPIDPSQLPAAKTLATPVADTQGSAADKPAATVIGKVDKLQGDAWIVHDGQKVPAKIGAALMQGDSVETAQGAQISLVFADRTTFVLKDKGLVGLDEFSYDPATKTGKETFLVAQGAFSFVSGDIAKTQPDAARLATPVMTMGIRGTTVGGTVAADGNTSVALLPDPGSNFVGEVAISALGGGQSFTLNSAGSGIVGASSGGSWSVSANAGAAIASSMPSPAPPPVAPPVLPSAPSGTGTGGPGNTGTGNAGTGETHNTAPEPPPLPPQPVGLPTPNPEPKPEPKPEPKPEPKPEPKSDPPKPDPVQQNHDPTTSDVTLPGSTAGTSITFSKSELLANARDSDGDALSIKLNSGHSDHGTAVVNADGSITFTATAGYSGAATITYTITDGHGGSVQGTAFSAVTVGTQVTTAGTDHLDGGAGASAYLSSVANFTAGDTISDSGGLDTLTVSDAGTINLAAGTVTGIEILTLAAGGNTVILGGGVNPQQFTTIVGGAGTDVIKQADGGGTFDLTGIVLTSVESIATGTGTSSITFDEVSAAGVNTVVDAVSGDGDSVTFYQTTAGTLNISAKTFVNIEGIILDGSTASGDVVLVGGAQGATIIGGSGNDTLSGGAGADSFIGGSGNDVIYANQGDPLINGGIGTDTLVITATTFDDNNFDDTHLQGIEVINITNASVAGQYFKVDNQSEGFTINVTSSAHVTVLGGTGNDVINGGSAGEYLWGYQGNDTITGNAGNDTIVGDAGADVAVFTGNAADYLLTTSSGTLTVTDRSGTDGTDTLTGIETLTFADGSFAVSASGTTLTALGASSTLTVGSGFAEVIMGSGTNKLVTDMATLSAGLSILGGAGLDTVVISDTASMGSVQMPALTGIETLTLASSITAAQSVYLGGQAESAGLNVVDASAATGAVEIHGAFRSDDLTLTGGSGNDTIHGAAGNDTLVGGGGSNTIDAGAGTDTVSYGSMGSGITATLNGSSAVVTHSASTDTVTNTEILRGSGHDDVFFVASASVGVTVDGGAGVDTMDYSAMGAGITATVTGTSASVVHAGGTDAITNVEAWVGSAHDDTFIGDSGGDTFFGGIGADHLTGGGGADTFVYTDVNQSQDSASVRDVITDFTTGTDHIDISLSGTHVDVSGFEVVGSYNAGQSSLTGGVARTGGVEGDGFYSTFDQALYIYQGSTDSGIGTDGGYVIGSAGTITAADLNFNITGTAGNDTLVGGLGNDILAGGTGTNTLTGGGGSDSFVLDSTGTAVITDFNSAADNITLSNGSFGLGSSGTLTAGTVGATYAEGTTSISSTAQDFGDANAGIVAIQNGANVELWHTTNMGAADNTNSTLVGTLNNVNTSALDQTNFHLAV

SEQ ID NO: 124 - protein, 807 aa, Magnetospirillum magnetotacticum
FEVATGTQSVTLDAYAASAGVTRIDASGASGGVANTGGVTVNASAYSTAVSISGGSGADTFTGGSGADSFVGGGGNDVIHAASNDALIDGGAGTADVLSVDAVNFDDGLGNNGQIVNIETINITNATTAGQWFKFDDQSDGFTINVTSSANVTVQGSQGNDIINGGNAGEFLWGDQGNDTIAGGQGNDTILGGAGTDVAVFTGAMANYAVTASGGTLTVAAQSGTDGTDKLSGMETLAFTDGSFTVSASGTTLTALGSSSTLTVGSGITEVVMGSGTNEVITDMATLSAGLSILGGAGLDQLKISDTASVGSVQLAALSGVEMLTLSSTNTTSQTVNLGSDGVNSEVTVIDASAATGGVYINAAPRTTGLTLIGGAGNDQFLGSLGNDTITGGGGTNSMDGGGGTDTVSYGSMTSGITASIDGTSATITHSTGTDSLTNVAILQGSNYADTFSVASASAGVTVDGGSGVDTMDYSAMGAGITATVTGTSASVVHSGGTDAITHVEVLVGSGYDDVFTGGTGNDTFSGGAGNDTFFGGVGADQLTGGLGADTFVYTAAAQSQDSLSARDIISDFTTGTDHIKLSLTGTHVDVSTFNDSAGSYNGGQATLMLGGVVGDGFYSSGDAAFYIYTQGTTSAVGSGDYVIGSTNAIHAVDLQFDITGTTGNDTLVGGAGDDTLAGGAGTNTLSGGSGSDTFVLDAGATSTAVITDFNTAADNVTLSNASFGLGSSGTLNNGVNYAEGTTTISGAAQNFGSGTDGVVAIQNGANVEVWHTTNMAAADNTNSHLMATLNNVNTSALDQTNFHLAV

SEQ ID NO: 125 - protein, 715 aa, Magnetospirillum sp. SO-1
PPPNDKPTASPVTLSGSTSGTTVTITFETLLSTASDKNNDALFIKAGSFTSSQGAFSNETATSVDFTPNAGYSGTATISYVITDKRPGGEITNTASSTVAIGTMVTTSGVDTYDGGAGANNYETAVANFTAGDSIADTGASGTDTLTVTDAGTLDLAAGTVTGIDVLALAAGGNTVILGGGANPQQFTTIVGGAGTDVIRQADGGGAFDLTGIVLTSVESIATGTGTSSITFDDVSAAGAGVVVDSASSDGDSVTFYQTVAGTLDISGKTITNFEGIILDGSTSSGNVVLVGGAQAATIIGGSGNDTLTGGAGVDSFTGSLGDDVIHGASGDALMDGGGGTGDVLSVDAVNFDDVNDGQIANIETVNITSASTAGQWFKFDNQSDGFTINVTSSQNVTVQGSQGNDIVNGGNAGEYLWGDGGNDTITGGQGNDTILGAAGTDVAVFNNNAQDYSYTLSGTTITVAAQSGTDGTDKVDTVETLRFADGDVAVTTNAGVAVSAMNFSTVTGSITVDASALTTALTLTGSNGADTFTGGSGADSFLGGLGDDVIYGASNDAVMDGGGGTGDVLSIGAVNFEDGLGANGQIVNIETINLTNATTAGQWFKFDDQNDGFTINITSTATVTVQGSQGNDVINGGNGGEYLFSDQGNDTVYGGQGNDVIDAGAGTNVVGFSGAASNYAISLSSSTLTVAAQSGSDGTDTVTNVQTLRFSDRD

SEQ ID NO: 126 - protein, 157 aa, Magnetospirillum sp. SO-1
VVGSDFNDSITGSDAGANYLDGGFGANILTGGTGAAVDTFVLHSSADATATQTITDFEVGTDHLALSDREFDLGSSGTLTTGTTGATYAEGTTTISGAAQDFGDANAGIVAIDNGGNVELWHTTDMSAADSTNSHLVGTLNGVNTSALDNTSFHLAV

SEQ ID NO: 127 - protein, 207 aa, Magnetospirillum magnetotacticum
MHIDPSQLPAAKNLATPVADTKDAGADKSAAVVIGKVDKLQGDAWVIHDGQKVPAKIGAALMQGDSVETAQGAQISLVFADRTTFVLKDKGLVGLDEFSYDPATKTGKESFLVAQGGFSFVSGDIAKTQPDAARLATPVMTMGIRGTTVGGSVAADGNTSVALFPDPGSNFVGEVSVAALGGGGQSFTLNSAGSGIVGASSGGSWSV

SEQ ID NO: 128 - protein, 209 aa, Magnetospirillum magneticum AMB-1
MRLDPSILPAAPNLTSLMADSVPSGTDKPSAKAVIGKIDKLSGDAWIIHDGQKVPAKTGAALVQGDSVETAQGAQISLVFADRTTFTLKDKGLVGLDEFTYDPASKTGKESFLVAQGGFSFVSGDIAKTQPDSARIVTPVMSLGIRGTTVAGSVGEGGATTVALLPDPGSNFVGEVAVSALSGGGQSFTLNSAGSGIVGATSAGSWSVS

SEQ ID NO: 129 - protein, 529 aa, Magnetospirillum magneticum AMB-1
LSGISTLEINTGSAALNLTLGTVAEAAGTGVVDGSQATGSIVANASAYSTGLDITTGSGNDTITTGSGSDTIAGGLGSNIINAATGIDTVDYGAALSAITATIGSGSATVVHSGGTDTLSGVEIIQGSTFGDTFIVGVASTGSILGGGGSDVLDITALPTGNLALDGAGANESIHFDIAGRHMESLVRDLSLSGSNLVAVLDGGGTLSIASVTTDTIIDPAGDTHRIVGQGGATTAGTDYVVVGTASDSSLTGNTGDDLLVWHSGNTSLVGGGGHDLADFRHAAGAIVADMYGGTSAVIGGSTTVGLSGISEILGGNSADTLTAGTGEWMLAGGGGNNVMDGSHGTTTVSYQDQVTGVTIDLAGGTATHGAYTDTLTGMGGAVGSDFADTIIGGTGAEYLDGGFGANTVTGGSGVDTFVLHSSTSATATQSITDFAGDQFSLSDREFGLGSSGTLAAANYAEGTATVSGSAQDFGNVNAGIVAIQNGANVELWHTTNMDAATSSNSHLVGTLENINTSALDNTNFHLAI

SEQ ID NO: 130 - protein, 5299 aa, Magnetospirillum magneticum AMB-1
  misc_feature (889)..(889): Xaa can be any naturally occurring amino acid
  misc_feature (2656)..(2656): Xaa can be any naturally occurring amino acid
  misc_feature (2825)..(2825): Xaa can be any naturally occurring amino acid
  misc_feature (3672)..(3672): Xaa can be any naturally occurring amino acid
MSDRVFVRLEQRAVLEVGGEDRRAFLQGLVSNDMNKVAGDRAVYTALLTPQGKFLYDLFVVELGDVFLIDAEAARIEELRKKLSMYKLRSKVSVAVAANVAVFALMGEGAASTFDLAAEAGAATEFRDQGRDAVPQTGTGPVAGATITSQVQEVVQAEVAAAPAVDNAPDIQAVAVNHAPIVAGVADIGTIDEDHPLTMTAAEWQAKLLANATDSDGDTLSILSLDDIRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTINGXNDTATISGDIAGGVGEDGTGTATGTLNVSDVDNGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGAGDSMTKTFTVTSADGTDTQEVTVTINGSNDNATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANDSMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANDSMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTSTATGTLNVSDVDNGEAHVQATSIETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVADVDNGEAHVQATSVETDQGTFTIGEDGKWSFALNNDDPAVQALGAGDSMTKTFTVTSADGTDTQEVTVTINGSNDNATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTIHGSNDSATISGDIAGGVGEDGTSTATGTLNVSDVDXGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIXGSNDSATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGANESMTKTFTVTSADGTDTQEVTVTINGSNDSATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVXDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGANESMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGAGDSMTKTFTVTSADGTDTQEVTVTINGSNDGPVVSGPVDLGATAEDHSITFTAQQLLGHASDIDGDSLSVSNLSAGNGTISQNADGSYTFTPNADFNGEVNVTYTVSDGHGGTTSGSASFDVTSVNDGPTTSDVTLASGTEDRSVTIKASDLLGNAHDVDGDTLSVSNLSASNGTITDNHDGTYTFTPNHDFSGNVDLSYTVSDGQGGSTAGTAHFGMAAVADSPVLSASNITVDLGAGQAQTLNGTTGNDTLSGGSGNDVVNGSSGDDVLYGDGTGSVTVPLNISDRLSDTDGSESLGSVTIGGLPAGASLSAGTHNSDGTWTLTPAQLTGLSVTTTEGTALHLSVTATSTEASNGSTATTTTSFDVSFSGTAAGNDTLDGGAGNDTLFGGAGNDTLTGGAGADLLEGGDGNDVLNYSTDGTWSGGFVSQNVGDTTHAGTNETYTITGDNDSQDVFRGGAGTDTLVMGSGNDALFLDDGYSGSPTGGARIDGIESIVAGDGNDVVDLTSSKYTYGDVTIDGGAGNDVLMGNAGNDVIDGGTGNDVLYGASGNDTLRGGDGADTLDGGYGADTIDAGAGNDLGIIKGGQSAGDNYDGGTGTDTLRIDLSGSQYTAAVRAELQQFQSFIADPAHAGQSFHFNTLGVDAKNWESLKLTVDGRDVSLENAPTVTSATAVSTDEDHSGAGRVVGTDQDVGDSVRYHLMDASGNQVDSLSTAHGTVTINSATGEYTFTPNADAQSLRAGDVQTDSFKVVATDGTMTSAPSTVGVTITGSNDGAVITGTSVGTVGEDGNRSVTGTLNVADVDQGQAHVTAQTVQTDQGTFSIGENGQWTFQVNSGNADVQALGAGESMTKTFAVASADGTATQNVTVTINGANDSATISGSTTGAVAEDGNGRATGTLSVADVDHGQAHVTAQTVQTDQGTFSIGENGQWTFQVNSANADVQALGAGESMTKTFAVASADGTAPRT

SEQ ID NO: 131 - protein, 3060 aa, Magnetospirillum magneticum AMB-1
  misc_feature (1317)..(1317): Xaa can be any naturally occurring amino acid
MAENNNSNPPHDQHDGAEENAQQSLDDLTVLQNVQNQNMGDARLNVARAVDVSDTQLGNLANVQQGSTGSPQVQNLGGIAGGANISVDVEIEAAKDNSVAPPELDGLAVDIRDEAPTISVNPGGAKPLNVQELPDLARPDAEFRDQGRDAVPQTGTGPVAGATITSQVQEVVQAEVAAAPAVDNAPDIQAVAVNHAPIVAGVADIGTIDEDHPLTMTAAEWQAKLLANATDSDGDTLSILSLDDIRIDHGSFARNADGTYTFTPDANFNGEINATYTISDGHGGLATGSASLHVNAVNDAAEITGDTAVVVGEDTARAAGNLDATDIDSPATFVAATTADDYGTFSVDESGQWSFAMNDSVQSLGAGDHLTRTFEVQTADGTSQTVTVTIDGANDQAVISGDAKDLSGSVGEDGTQTATGTLHVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVADVDNGEAHVQATSVETDQGTFTIGEDGKWSFALNNDDPAVQALGANESMTKTFTVTSADGTDTQEVTVTINGSNDSATISGDIAGGVGEDGTSTATGTLSVADVDNGEAHVQATSIETDQGTFTIGEDGKWSFALNNDDPAVQALGANESMTKTFTVTSADGTDTQEVTVTINGSNDSATISGDIAGGVGEDGTSTATGTLNVSDVDNGEAHVQATSIETDQGTFTIGEDGKWSFALNNDDPAVQALGANESMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTATGTLNVSDVDSGEAHVQATSVETDQGTFTIGEDGKWSFALNNDDPAVQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDXATISGDIAGGVGEDGTSTATGTLHVSDVDTGEAHVQATSVETDQGTFTIGEDGKWSFALNNDDPAVQALGANESMTKTFTVTSADGTDTQEVTVTIHGSNDSATISGDIAGGVGEDGTGTATGTLNVADVDNGEAHVQATSVETDQGTFTIGEDGKWSFALNNDDPAVQALGANDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANESMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGANDSMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGAGDSMTKTFTVTSADGTDTQEVTVTIHGSNDSATISGDIAGGVGEDGTGTATGTLNVADVDNGEAHVQATSVETDQGTFTIGEDGKWSFALNNDDPAVQALGAGDSMTKTFTVTSADGTDTQEVTVTINGSNDSATISGDIAGGVGEDGTQAATGTLNVADVDSGEAHVQATSVETDQGTFTIGEDGKWSFALNNDDPAVQALGANDSMTKTFTVTSADGTDTQEVTVTIHGSNDSATISGDIAGGVGEDGTSTATGTLHVSDVDTGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDSGEAHVQATSVETDQGTFTIGEDGKWSFALNNDDPAVQALGANDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTSTASGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGIGTATGTLNVSDVDNGEAHVQATSVETDQGTFTIGEDGKWSFALNNDDPAVQALGAGDSMTKTFTVTSADGTDTQEVTVTIHGSNDSATISGDIAGGVGEDGTGTATGTLNVSDVDNGEAHVQATSVETDQGTFTIGEDGKWSFALNNDDPAVQALGANESMTKTFTVTSADGTDTQEVTVTINGSNDGPVVSGPVDLGATAEDHSITFTAQQLLGHASDIDGDSLSVSNLSAGNGTISQNADGSYTFTPNADFNGEVNVTYTVSDGHGGTTSGSASFDVTSVNDGPTTSDVTLASGTED

SEQ ID NO: 132 - protein, 1274 aa, Magnetospirillum magneticum AMB-1
MRLDPSILPAAPNLTSLMADSVPSGTDKPSAKAVIGKIDKLSGDAWIIHDGQKVPAKTGAALVQGDSVETAQGAQISLVFADRTTFTLKDKGLVGLDEFTYDPASKTGKESFLVAQGGFSFVSGDIAKTQPDSARIVTPVMSLGIRGTTVAGSVGEGGATTVALLPDPGSNFVGEVAVSALSGGGQSFTLNSAGSGIVGATSAGSWSVSANAAAAVAALAPQPAPPPAVAPALPAAPAPAPAGGTGAGGSKGAGQGAGAGGGAEAAVVDVAPPPPPPPPPPPPPPPPPPPPSPPAPAPPPPPPAPPPPPPAPPPPAPVNNDPTSSAVTLPGSTAGSATTILKSDLLANASDPNHDVLSIRLGSVSATHGTVTETATTVVFTPTTGYSGPATLSYTIVDGRGGLVTASATTTVSAPSHGLLAEVASNPIVNGDFETGTFTGWVASLSPTVANGGSPLTNWMVYPASSLNGSHVALNGFDGGVLDGNGAILYETPLYFHLQQPITLTGAPVHASLSFSFKVSGGPSFSVARDGQPTADRVFTVHVTDGSGDVMPTVYTYTVPGTTVDAGAVHNVNIDLSSQMAALSPGTYTLDLQELVPQYYTGPAEIQLDNIALKLSQGSATASEAVTADQGVSGWVLGLPATTASSDTVSFHIIDGSGNPQSSLATTHGTASIDAITGKWTFTPLATLAANLSVTDTFVVGVVDDQTSQVAQATIQVNISSPVTSSGAVAHITSASTVVDANFSGLSGISTLEINTGSAALNLTLGTVAEAAGTGVVDGSQATGSIVANASAYSTGLDITTGSGNDTITTGSGSDTIAGGLGSNIINAATGIDTVDYGAALSAITATIGSGSATVVHSGGTDTLSGVEIIQGSTFGDTFIVGVASTGSILGGGGSDVLDITALPTGNLALDGAGANESIHFDIAGRHMESLVRDLSLSGSNLVAVLDGGGTLSIASVTTDTIIDPAGDTHRIVGQGGATTAGTDYVVVGTASDSSLTGNTGDDLLVWHSGNTSLVGGGGHDLADFRHAAGAIVADMYGGTSAVIGGSTTVGLSGISEILGGNSADTLTAGTGEWMLAGGGGNNVMDGSHGTTTVSYQDQVTGVTIDLAGGTATHGAYTDTLTGMGGAVGSDFADTIIGGTGAEYLDGGFGANTVTGGSGVDTFVLHSSTSATATQSITDFAGDQFSLSDREFGLGSSGTLAAANYAEGTATVSGSAQDFGNVNAGIVAIQNGANVELWHTTNMDAATSSNSHLVGTLENINTSALDNTNFHLAI

SEQ ID NO: 133 - protein, 511 aa, Magnetospirillum sp. SO-1
VVDASAANGIVKVYGTSRSADLTLTGGAGSDSLYGGGGGDTLVGGSGSNILDGGSGTDVASYASMGAGITATISGAAATVVHSGGTDTVTNVEVLTGSTYGDSVSINGTVAGTFAGGGGTDHVTLTASPTANLTIGNSSGNGAMTLDIAGRTADSVVRDMAWSGSDMVLTFDGGGTVTNVGNALNGVVDPLDGSTRYIVGEGGATTAGTDYIVVGKASDTSLTGNSGDDLLLWHSGNATLTGGGGTDTADFGHASGAVVANLYSGTTAVIGGSETVHLQSAFTEIRGGDYNDTLTAGTGATTLMGGDGSNVLDGSQSTSATASYRDQLAGVTVSLSSGTAIHGAGTDTLTGISNVVGSDFNDSITGSDAGANYLDGGFGANILTGGTGAAVDTFVLHSSADATATQTITDFEVGTDHLALSDREFDLGSSGTLTTGTTGATYAEGTTTISGAAQDFGDANAGIVAIDNGGNVELWHTTDMSAADSTNSHLVGTLNGVNTSALDNTSFHLAV

SEQ ID NO: 134 - protein, 208 aa, Magnetospirillum sp. SO-1
MYIDPSQVPAAKNLATPVADIQDAADKPAGNVVIGKVDKLQGDAWIVRNGQEAPAQIGAPLVQGDSVKTSSGSQISLVFADRSTFVLKDQGLVGLDEFSYNPATKTGKETLLVAKGSFSFVSGDIAKTQPDAARLATPVMSLGIRGTTVAGAVGADGNTTVALLPDPGSNFVGEVAVSALGGGGGSFTLNSAGSGIVGATSGGSWSVS

SEQ ID NO: 135 - protein, 404 aa, Magnetospirillum magneticum AMB-1
MPIDPSQLPAAKTLATPVADTQGSAADKPAATVIGKVDKLQGDAWIVHDGQKVPAKIGAALMQGDSVETAQGAQISLVFADRTTFVLKDKGLVGLDEFSYDPATKTGKETFLVAQGAFSFVSGDIAKTQPDAARLATPVMTMGIRGTTVGGTVAADGNTSVALLPDPGSNFVGEVAISALGGGQSFTLNSAGSGIVGASSGGSWSVSANAGAAIASSMPSPAPPPVAPPVLPSAPSGTGTGGPGNTGTGNAGTGETHNTAPEPPPLPPQPVGLPTPNPEPKPEPKPEPKPEPKPEPKSDPPKPDPVQQNHDPTTSDVTLPGSTAGTSITFSKSELLANARDSDGDALSIKLNSGHSDHGTAVVNADGSITFTATAGYSGAATITYTITDGHGGSVQGTAFSAVT

SEQ ID NO: 136 - protein, 207 aa, Magnetospirillum magnetotacticum; identical to SEQ ID NO: 127

SEQ ID NO: 137 - protein, 505 aa, Magnetospirillum magnetotacticum
KISDTASVGSVQLAALSGVEMLTLSSTNTTSQTVNLGSDGVNSEVTVIDASAATGGVYINAAPRTTGLTLIGGAGNDQFLGSLGNDTITGGGGTNSMDGGGGTDTVSYGSMTSGITASIDGTSATITHSTGTDSLTNVAILQGSNYADTFSVASASAGVTVDGGSGVDTMDYSAMGAGITATVTGTSASVVHSGGTDAITHVEVLVGSGYDDVFTGGTGNDTFSGGAGNDTFFGGVGADQLTGGLGADTFVYTAAAQSQDSLSARDIISDFTTGTDHIKLSLTGTHVDVSTFNDSAGSYNGGQATLMLGGVVGDGFYSSGDAAFYIYTQGTTSAVGSGDYVIGSTNAIHAVDLQFDITGTTGNDTLVGGAGDDTLAGGAGTNTLSGGSGSDTFVLDAGATSTAVITDFNTAADNVTLSNASFGLGSSGTLNNGVNYAEGTTTISGAAQNFGSGTDGVVAIQNGANVEVWHTTNMAAADNTNSHLMATLNNVNTSALDQTNFHLAV

SEQ ID NO: 138 - protein, 171 aa, Magnetospirillum magnetotacticum
VDNGNGTYTYTPATNYTGPVNFTYTVTDGHGGTVADSASTGVITPTSVLTQVGTVLHSTSASNVVDTDFFGISGADTLVFEVATGTQSVTLDAYAASAGVTRIDASGASGGVANTGGVTVNASAYSTAVSISGGSGADTFTGGSGADSFVGGGGNDVIHAASNDALIDGGA

SEQ ID NO: 139 - protein, 99 aa, Magnetospirillum magnetotacticum
NDAPTLTGSGTVAMAGSPIAGAATTISIASLVSNATDAESDALTISAVSASNGTAVISGSNIVYTPSSSGVLTLTYTVDDGHGGTVTDYATISVGASAN

SEQ ID NO: 140 - protein, 98 aa, Magnetospirillum magnetotacticum
ASANHAPVSNATPTLLTLAEDTSVNIAGSWLKSQFTTNATDADGDTLTVTNITANHGNLSLLGDGSYTFVPDADFNGTATLTATIDDGHGGTTTGQAT

SEQ ID NO: 141 - protein, 949 aa, Magnetospirillum magneticum AMB-1
SGNGSAIVTAVSLTGAKASLFDDAVVTREDTELRAGLFDVDHLNYSQPTWATVAQGPQHGTLSLVGTTVLGTTTLSAGSVFLTGGSMSAGASGYSYTPDANYFGSDYFVVAINDGSGNLTYGTVGIGVRSVRDAPAIVGGADFSVVKNGSETLNLQVVDEVGALGGDQYSVALTVGIGSLSLHTTGGISFTAGSNGSHSMVFTGSLDRINAALMEVVYQSDPASTGENINLTVTDLSNGSITVSKTMAVTVSPANLAPEITGGDIGESVAGAVYNGMLLATDPEGGQLTFTKTGNPSHGTATVTDAATGAYTYTGTAGYSGWDSFTWSVGDGVTTTIGGIEHIAVYDHNRTWAGGASGTWGTAASWNTTLVPDSDARAVIGNATVDHLSGSDSVAGLSLSGATLNLSGGTLALGLEGRLDGPSQLNVAGGVLSLASGAILSDFGGFDLSTGGSLAGSGYLGISGAAVMSGTVGIGGNTLAVYNGGAMTSTSLSGTGTMRVQGGSFIMKGADYIGSYLEVAAAAVLYMDSNLTVGTDSVSASVHLAHAFNNYGDIQMTGGSGFVGTSLMVADALTNHGSIEVGGFNGAGTIAATSFSNYGEVNVGHALNLVADAFDNHATLTLSNNHMLTVSDTSATSHALIDNLGKIAGSGTINATDADFINHGYINPGDSSSAGTLGVTGSLSLAESSHLVLDYWNGSFDRMNVSGSLTLDGTLDIYSHGTISGNPTATLLTWGTGGLSGAFEVIHGIDSGTGWIWDPTLNGTSLSVTAHAATTVNGNSTYNGGATADYVIGLGQNEMVHLGGGADVYAGHGSYNTIGVSDMNFHFLDGGAGGGNTLQWENLNNQAFDLTGLWNNAVQNFDVLDLSHANNNNAVLDLAHLQSMLNGTNAVTGTGNALVVIGGNSVTLAGSGWQANGTAELTVNGQHDSYTQYSNGDTHVYVENHTHVG

SEQ ID NO: 142 - protein, 101 aa, Magnetospirillum magneticum AMB-1
VVNMAGPDATATGNVTASVGPYGSAPVGSDHVSTYAGHAISGTVSIFDQEGSGLTLSQTGTAPAHGTLSLGANGAFTYTPTSGYVGSDTFTLQLSDGTSSS

SEQ ID NO: 143 - protein, 118 aa, Magnetospirillum magneticum AMB-1
VYDPDPAFTGHDKFVVQADDGHGGITTQTISVAVSNSGVFNQSPVSGGTLLLEGSYGMTLSQSAATTDPDGDSLSYSIVGGSLTAHGTATVNGSGMVSYTGNTGFGGSETLTLRTSDG

SEQ ID NO: 144 - protein, 945 aa, Magnetospirillum sp. SO-1
TGNGDGTVTAISFSGAKAAIFDDVVTTREDTEVRSSLFDVNHLNSTQPTWATVVQGPQHGTLDLTGTTVLGTTTLSAGSVFLTGGSLSAGAGGYSYTPDANYFGSDYFVVAIDDGSGNLTYGTVGIGVRSVRDEPVLSGTGGFSVAENGSHTLNIQVADEVGALGGDQFTVNMTIGHGSVTLDTVGGITFSSGTVNGSSHLIFSGTLDRINAALSGAVYTAESLWTGSDSIALSVWDAANGTSLVSSETIAVTTSGSGNLAPETEQIDIGSSVAGAVHNGMLMASDPEGGTLTFAKTGDPTHGTVTVGSGGGYAYNGSAGYTGWDSFGYSVSDGANTVTATAQVAVYDHTRTWDGGASGTWSAAAGWSGDTLPDSGALVQIGAATIDHMSGSDAIGGLSLTGASLTLSGGTVSLAVAGELDNASRLSIGGTAVLSLADDAILTDYGSFNLSGGGTLAGDGTLVANGVTTLSGTAGLGANTVILNNGATLSGASLSGTGNVRLNNGSIFIAATSNWIGAAFETAAATLLLIDSNGGSANLTLGHAFDNTGEIQLTGNGAFTTSVVVDDALTNSGSIVSGGFTSFASTIAATSFDNFGVLEVGHALDLTVGTFDNHATLTLSGGNALTITDNTAGTHAQFDNLGKIGGSGTINAADADFVSHGYINPGDTSSAGTLSVTGDMIFGDDAHLVLNSWAGSFDRLNVSGELTLDGMLDLYTNSNPTGGQSATLLSWGTLSGSFEVIHGIDSGSGWIWDPTVTGNSLSVTAHNLTGTVSGNGYYSGSGTADYVVGYGSNHEVHLGGGDDVYVGHGSYNTIGVTDTAFDFLDGGNGGGNTLQWENINGQSFDLSALWNNVLQNFDVLDLSRASNGSATLDLAHLQSMLNGTNAFTGTANALVVIGADNLTLADSGWQAVGSAELTVNGQQDSYTQYANGNTNVYVDSQTHVG

SEQ ID NO: 145 - protein, 101 aa, Magnetospirillum sp. SO-1
PDHGALVLGGRVLAVGDAFNASDLVAGTMGLNYYNDGSAHASDSFQLRLTDGQTPLAPQTVSIAVQPVNQAPVAGAGAGYALYMTGSNNEAVMVNDAGGKL

SEQ ID NO: 146 - protein, 296 aa, Magnetospirillum sp. SO-1
VAGGTKTAHGTVTITGGNLTYTADTGYAGSDTFTVEANDGTGNVVAQAFTANVGYDSHALTLATPTLAVGQSGTFTLNEAYLNPMNGIQVGDTNLVYTVGGGLAPLGVLMKGTLALGAGATFTQADVAAGLISFVADGAPGVDSFDFSLTDGIGGTLTGNTIVSFSVIASNTAPALTVASGLTAAQGSSLNIMSGPSGLDASDSNGGPASQLLSYIVTDLPDHGALVLGGRVLAVGDAFNASDLVAGTMGLNYYNDGSAHASDSFQLRLTDGQTPLAPQTVSIAVQPVNQAPVAGA

SEQ ID NO: 147 - protein, 149 aa, Magnetospirillum sp. SO-1
SGPAGTAAQNFLGDIADVRIWGATRTQAQVQADMAPAEEGAQSGLLGAWTVENGEIVTLTGPAVTDSGTVSVLTGAPVGGDHIATYAGHAVSGTVATFDQDGGTLTLGIETGGEPASGTLTLGANGTFTYTPDTGFVGTDSFTLELDDG

SEQ ID NO: 148 - protein, 698 aa, Magnetospirillum magnetotacticum
QAIAGAAATSGTVASALDPEGSSLTYHLSGTKTVSGNTETLVTSSGTIALDTTTGVYGYTATAGQAALDIITYTVTDTTGHVSTRTIRAAEYDHSRSWGGGMGAWETAANWTGSLAPDSLALATITNGTVSHASGSDTMGGLKLTGSSLSLSGGTVALTVTGGADNNSAININGGTLALSNSSMLYKDFGALNFTSGAMTGGGTFIAFGTTNLAVASSTDQLDAKLMLTKGGSLSGGTMTGAGTLNLAGGNLFVTGAGNDIGVAFQNAAATMLLLEGTNAGANTTLTLEHAFDNLGVVDMFGFSGASGALSLNVLGALTNDGSIVAETSAGSAYQVSATNFDNYGVVQIARNLGLTVGTFDNHATLTLAGTQMLTVSDNVAATHAHFYNHGKIEGAGTLNVTDADFVNHGYLTPGDSSSAGTLAVTGSLTLASDSHLVLDYWSGTGFDRLNVSDSLTLDGTLDIYSHGAPTNGASATLLSWGGTSGLSGSFEVIHGIDSNTGYIWDPTLSGTSLSVTAHAVTSTIYSNSEYNGTSGADYVVGYGANEVVHLGGGADVYAGHGNYNTVGVSDLNFHFLDGGAGGGNTLQWENQTNQTFDLSALWNNAVQNFDVLDLGHASNNNAVLDLAHLHSIVNGTNAVTGTSNALVVIGGNSVTLAGSGWRADATAELTVNGQHDSYTQYSNGDTHVYVQNHTHVG

SEQ ID NO: 149 - protein, 240 aa, Magnetospirillum magnetotacticum
SLYNDAAITREDTELRSGLFDPDYASTTASVNVRIVQGPQHGTVLLTNGTTVLGAGASTTSGTGQTPGSAGYVYTPDANFFGSDYFVVGVTDPGGNLTYGTIGIGVRSVHDEPTLSGLSDFSVAENGSQTLNVQVSDDIGALGGDRFSATITASHGGVTLHTLGGVTITSGSNGGHSLVFTGTLDRINAALNGAVYQSDSMWTGGDSVNFQVTDISNGSLTGSGSMAVSLSGANNLAPVI

SEQ ID NO: 150 - protein, 101 aa, Magnetospirillum magnetotacticum
VTNLVGPAATATGNVTAVEGPYGSAPVGSDHISTYAGHEVSGLVSAVDQDGGTLVLSQTGTAPAHGTLNFGANGAFTYTPTTGYVGSDTFTLSLTDGTATT

SEQ ID NO: 151 - protein, 295 aa, Magnetospirillum magnetotacticum
SLVGATKTAHGTVTVTGAALTYQADSGYVGSDTFTINADDGHGNVVAQAFTANMGYDWHSLTLAPPNLIVGQTGTFTLNEAYLRPYDAIQVGDSNLVYTVGTLAHQGTLYKGSTALASGATFTQADVNADIITYVAAGTVGADAIDLVVNDGMGGTLTGMGSLSLTVVASNTAPTLTVGSTFVDSQGSSINIMSGANGLNATDSEGAAAAQLSYVVTDLPDYGALVVNGRVLAVGDAFSGADLSGGTMGLRYFNDGSSHTSDSFQVRLSDGQYLTSPQTVSITVQSVNQAPVAGA

SEQ ID NO: 152 - protein, 462 aa, Phaeospirillum fulvum MGU-K5
SLSGARLAGTGTLDLVSGGSLALRLATEVGIALTTAAAAQILIDGGTASASVLFDQTLINNGTLTLSAGAGNSAALSVAPGMENYGTLLVSGDAAGSAAINADNLGNSGQMTVGQDLTVTAREFGNGGTLTVNATLALRDDTDSAPDSHLAFTNDGLLAGTGTLDLSDATFTNQGYLSPGGLGTAGTLTVEGAMTLGNSSVLALDLAGPAISDHLTVQGGALTYGGTLVFSILANPTLDTPISVISAPDQPIAGYFTALRGMDNGTLVVDPLFGGHGLSVALHAATRLGSNATYDSSGETVNDYLIGTGINETVSLKGGADVFVGHGGGNRIGVSALDFHFIDGGAVGGNELRWDGGSDSLFDATQIRPEALQHFDLLNLSGGGDAVLDYAHVKAMTGGTNSYTGTGHTLLVIGGDANHVQLAGGGWEHGDSVNVTVNGHQESYTQYSNDGVRVLVDHNAHI

SEQ ID NO: 153 - protein, 578 aa, Magnetospirillum gryphiswaldense MSR-1
GTSSTWTGGATPTTGDVAIITTGDVVSMASGSLTLDGLRSAGTLDLNGGTLTVNGATTFTNNSTLALSGTGIWAGSGDIHNHGILTLNGGTLGGTGTAYVAMDGQIAITGSSVLNRRLEIDSAMAQLNGGTLSGTGTLAVTEDGMLTVRGDSTLSATLSLAATPDYAGTVEILAESAASRLTLTKSFTNDGQIILNSSGIAGHSAGLALSSGTFTNAHLFTSTSNSVLNVLSATTVNTGTMQINGMGLDFAGISLTNAIGGVISVADISTLDINRAGASFINNGTLEGFGTIDVTGAGFTNNGLLRGGDDQVVGSLDIDGTVTLGANSTVEAYVGSNNGMDFSTLVNIDGQLNLNGILHITGNGSDLDGNTQVLSWDSASGSFSDIVGLDAPLAGGWAYDIRFDGNGIHVGTLHQSQYETTGDDFIQGSMGAEALAGGAGNDTLFSGGGSDVIFGQDGNDTIVLSDTDVHFVDGGAGIDTLSWYSPGPLDLTALRDELIQRVEILDIGHASVTLTAADVQAMTEGTNGFTNTANTLVINGNGGNVDFDDGAWTSGTNQTINGDSYAVYSKDGVSVYVE

SEQ ID NO: 154 - protein, 56 aa, Magnetospirillum gryphiswaldense MSR-1
GSLTVSPSGQVSYIPNANFNGIDSFTVSITDDQGAVSTRVVAIKVNAVNDLPTLTG

SEQ ID NO: 155 - protein, 56 aa, Magnetospirillum gryphiswaldense MSR-1
GTVSLNANGSYTYSPDRNYTGADSFLYSITDSQGLVSTASASINVTAVDDAFTVMG

SEQ ID NO: 156 - protein, 71 aa, Magnetospirillum gryphiswaldense MSR-1
GVVMPHDPDSDGSYTFTATTAPTNGSLSLHADGTFVYVPKYGYVGADSFTVQVANGVNTPVSKTFSVTVAD

SEQ ID NO: 157 - protein, 271 aa, Achromobacter piechaudii
ATTTTEDTAVNGQVSAVDGDGDPLAYSVGTAPTHGTVTVNATTGAYTYTPTADYYGSDSFVVAINDGTGNITLSTVSVTVSAVVDIANDSVTTNEDTTVNINVNANDTFENAGHTITAIDGNAIVVGTPVAVAKGMVTLKADGTLDFAPTANYNGSTSFTYTVTSGGVDETATVSITVTAVPDAPMVVDPAVPGQTFDSATGNYAVSTTEDVAVSGQVSAVDGDGDPLAYSVGTAPAHGTATVNAATGAYIYTPTADYYGSDSFVVAINDG

SEQ ID NO: 158 - protein, 226 aa, Achromobacter piechaudii
YTYTPTADYYGSDSFVVAINDGTGNISLSTVSVTVSAVVDIANDTVTTNEDTTVNINVNANDSFENAGHTITAIDGNAIVVGTPVAVANGMVTLKADGTLDFAPAANFNGSTSFTYTVTSGGVDETATVSVTVTAVADAPMTVDPAVPGQTFDSATGNYAVSTTEDAAVSGQVSAVDGDGDPLAYSVGTAPAHGTVTVNAATGAYTYTPTADYYGSDSFVVAISDG

SEQ ID NO: 159 - protein, 271 aa, Achromobacter piechaudii
ATTTNEDTAVTGQVSAVDGDGDPLAYSVGTAPAHGTVTVNASTGAYTYTPTADYYGSDSFVVAINDGTGNITFSTVSVTVSAVVDIANDSVTTNEDTSVNINVNANDSFENAGHTITAIDGNAIVVGTPVAVANGMVTLKADGTLDFAPAANYNGSTSFTYTVTSGGAVETATVSITVTAVPDAPMTVDPAVPGQTFDSATGNYATTTNEDTAVTGQVSAVDGDGDPLAYSVGTAPTHGTVTVNATTGAYTYTPTADYYGSDSFVVAIDDG

SEQ ID NO: 160 - protein, 271 aa, Achromobacter piechaudii
ATTTNEDTAVTGQVSAVDGDGDPLAYSVGTAPAHGTVTVNATTGAYTYTPTADYYGSDSFVVAISDGTGQVTLSTVSVTVSAVVDIANDSVTTNEDTTVNINVNANDSFENAGHAITAIDGNAVVVGTPVAVANGMVTLKADGTLDFAPAANYNGSTSFTYTVTSGGAVETATVSITVTAVPDAPMTVDPAVPGQTFDSATGNYAVSTTEDAAVSGQVSAVDGDGDPLAYSVGTPPAHGSVTIDPTTGAYTYTPTADYYGSDSFVVAINDG

SEQ ID NO: 161 - protein, 271 aa, Achromobacter piechaudii
ATTTNEDTAVTGQVAAVDGDGDPLAYSVGTAPAHGTVTVNATTGAYTYTPTADYYGSDSFIVAIDDGTGNITLSTVSVTVSAVVDIANDTVTTNEDTPLNINVNANDTFENAGHTITAIDGNAIIVGAPLAVANGTVLLRADGTLDFTPTANYNGSTSFTYTVTSGGAVETATVTVMVASVPDAPMTVDPAVPGQTFDSATGNYATTTTEDTAVTGQVSATDGDGDPLAYSVGTAPTHGTVTVNATTGAYTYTPTADYYGSDSFVVSIDDG

SEQ ID NO: 162 - protein, 234 aa, Achromobacter piechaudii
TVNAATGAYTYTPTADYYGSDSFVVAINDGTGNITLSTVSVTVSAVVDIANDSVTTNEDTTVNINVNANDSFENAGHTITAIDGNAIVVGTPVAVANGMVTLKADGTLDFAPAANYNGSTSFTYTVTSGGAVETATVGITVMAVPDAPMTVDPAVPGQTFDSATGNYATTTNEDTAVTGQVSAVDGDGDPLAYSVGTAPAHGTVTVNATTGAYTYTPTADYYGSDSFVVAINDG

SEQ ID NO: 163 - protein, 252 aa, Achromobacter piechaudii
DGDPLAYSVGTAPAHGTVTVNATTGAYTYTPTADYYGSDSFVVAINDGTGNITLSTVSVTVSAVVDIANDSVTTNEDTSVNINVNANDTFENAGHTITAIDGNAIVVGTPVAVANGMVTLKADGTLDFAPAANYNGSTSFTYTVTSGGAVETATVSITVTAVPDAPMTVDPAVPGQTFDSATGNYATTTTEDTAVTGQVSAVDGDGDPLAYSVGTAPAHGTVTVNATTGAYIYTPTADYYGSDSFVVAINDG

SEQ ID NO: 164 - protein, 234 aa, Achromobacter piechaudii
TVNASTGAYTYTPTADYYGSDSFVVAIDDGTGNITFSTVSVTVSAVVDIANDTVTTNEDTPVNINVNANDTFENSGHTITAIDGNAVVVGTPVAVANGMVTLKADGTLDFAPAANYNGSTSFTYTVTSGGVDETATVTISITAVPDAPMTVDPAIPGQTFDSATGNYATTTNEDTAVTGQVSAVDGDGDPLAYSVGTAPAHGTVTVNASTGAYTYTPTADYYGSDSFVVAIDDG

SEQ ID NO: 165 - protein, 237 aa, Achromobacter piechaudii
GSVTVDATTGAYTYTPTADYYGSDSFVVAINDGTGNITLSTVSVTVSAVVDIANDTVTTNEDTLVNINVNANDTFENAGHAITAIDGNAVVVGTPFAVANGMVTLKADGTIDFAPAANYNGSTSFTYTVTSGGVDETATVTVSITAVPDAPMTVDPAVPGQTFDSATGNYATTTTEDTAVTGQISAVDGDGDPLAYSVGTAPAHGTVTVNASTGAYTYTPTADYYGSDSFVVAIDDG

SEQ ID NO: 166 - protein, 252 aa, Achromobacter piechaudii
DGDPLAYSVGTAPTHGTVTVNATTGAYTYTPTADYYGSDSFVVSIDDGTGHVTSSTVSVTVSAVVDIANDTITTNEDTPVNINVNANDSFENAGHTITAIDGNAVVVGTPVAVANGMVTLKADGTLDFAPAANYNGSTSFTYTVSSGGVDETATVTVSITAVPDAPMTVDPAVPGQTFDSATGNYATTTTEDTAVTGQVLATDGDGDPLAYSVGTAPAHGTVTVNATTGAYTYTPTADYYGSDSFVVAINDG

SEQ ID NO: 167 - protein, 109 aa, Achromobacter piechaudii
VTSGGVDETATVSVSITPVPDAPMTVDPAVPGQTFDSATGNYATTTTEDTAVTGQVSAVDGDGDPLAYSVGTPPAHGSVTVDATTGAYTYTPTADYYGSDSFVVAINDG

SEQ ID NO: 168 - protein, 253 aa, Achromobacter piechaudii
TINATTGAYVYTPTGDYNGNDRFVVSIADGSGGSVQAVVNVVVSAVADITNDTVSTNEDTTVNIAVNGNDTFENAGHVVTAIDGHAAAVGVPVLVGNGSVTLRADGSLDFSPAANYNGTTSFTYTVSSGGVNETATVTVNVAAVNDSPVVPGGSVDLPLANGVDVPASQGLLVGATDADGDPLRVTQISVDGVAGSTPAGTPIVVPGRGTLLVRADGSYVFTPSSGFAGDLVVHYTVSDGNGGLTEATIRLHN

SEQ ID NO: 169 - protein, 216 aa, Solitalea canadensis
THGTLTLNADGSFTYTPTANFSGSDSFTYKANDGSSDSNVATVAITVNSVNDAPVANNDAKTTNEDVAVNGTVTATDVDGDALTFTKGSNPTNGSVVVNADGTYTYTPSANFNGTDSFTVKASDGKGGESTATMTITVTPVNDAPVANNDAKTTNEDVTVNGTVTATDVDGDALTFTKGSNPTNGSVVVNADGTYTYTPNANFNGTDSFTVKASDG

SEQ ID NO: 170 - protein, 223 aa, Solitalea canadensis
AVLVSGPTHGTLTLNADGSFTYTPTANFSGSDSFTYKANDGSSDSNVATVAITVNSVNDAPVANNDAKTTNEDVAVNGTVTATDVDGDALTFTKGSNPTNGSVVVNADGTYTYMPNANFNGTDSFTVKASDGKGGESTATVTITVTPVKDAPVANNDAKTTSEDVAVNGTVTATDVDGDTLTFTKGSNPTNGTVTVNADGTYTYTPNANFNGTDSFTVKASDG

SEQ ID NO: 171 - protein, 228 aa, Solitalea canadensis
AVLVSGPTHGTLTLNADGSFTYTPTANYSGSDSFTYKANDGSSDSNVATVTLTVTPVNDAPVAVNDVYSVNEDVVLTIAAKGVLTNDTDVENNTLTAVLVSGPAHGTLTLNADGSFTYTPTANFNGIDSFTYKANDGSSDSNVATVAITVNSVNDAPVANNDAKTTSEDVAVSGTVTATDVDGDALTFTKGSNPTNGTVTVNPDGAYTYTPNTNFNGTDSFTVKASDG

SEQ ID NO: 172 - protein, 214 aa, Solitalea canadensis
GTLTLNADGSFTYTPTANFSGSDSFTYKANDGSSDSNVATVVITVNSVNDAPVANNDAKTTNEDVAVNGTVTATDVDGDALTFTKGSNPTNGSVVVNADGTYTYTPNTNFNGTDSFTVKASDGKGGESTATVTITVTPVNDSPVANNDAKTTNEDVAVSGTVPATDVDGDALTFTKGSNPTNGTVTVNPDGAYTYTPNTNFNGTDSFTVKASDG

SEQ ID NO: 173 - protein, 228 aa, Solitalea canadensis
AVLVSGPTHGTLTLNADGSFTYTPTANYSGSDSFTYKANDGSSDSNVATVTLTVTPVNDAPVAVNDVYSVNEDVVLTIAAKGVLTNDTDVENNTLTAVLVSGPAHGTLTLNADGSFTYTPTANFNGIDSFTYKANDGSSDSNVATVVITVNSVNDAPVANNDAKATNEDVAVNGTVTATDVDGDALTFTKGSNPTNGSVVVNADGTYTYTPNTNFNGTDSFTVKASDG

SEQ ID NO: 174 - protein, 252 aa, Solitalea canadensis
TNGSVVVNIDGTYTYTPNADFNGKDSFDFIIKDGKGGETKVVIDVTVTPVNDAPIVTVDPVSTDENKPVTGKVTAKDADGDAPTAEKGTDPTNGTVVVNPDGTYTYTPKPGFNGKDSFEIVVKDGKGGETKVIVDVTVSPVNDAPVASNDNKTTNEDTPVSGKITATDADGDAMTFIKGSNPSNGTVVVNADGTYTYTPNADFNGTDSFTVKVSDGKGGETTATITITVKAVNDAPVVTAGPVTTTENTPVS

SEQ ID NO: 175 - protein, 221 aa, Solitalea canadensis
TNGSVVVNADGTYTYTPNTNFNGTDSFTVKASDGKGGESTATVTITVTPVNDSPVANNDAKTTNEDVAVSGTVPATDVDGDALTFTKGSNPTNGTVTVNPDGAYTYTPNTNFNGTDSFTVKASDGKGGESTATVTITVTPVNDAPVAVNDAYSVNEDAVLTIAAKGVLTNDTDVENNTLTAVLVSGPTHGTLTLNADGSFTYTPTANYSGSDSFTYKANDG

SEQ ID NO: 176 - protein, 236 aa, Solitalea canadensis
KVTSTDVDGDTLIAEKGTDPTNGTVVVNPDGTYTYTPKPGFNGKDSFEIVVKDGKGGETKVVVDVTVTPVNDAPVASNDSKTTNEDTPVNGKVAATDPDGDTLIFTKGNNPSNGTVVVNPDGTYTYTPNTDFNGKDSFEIVIKDGKGGETTVVIEVTVNPVNDAPVASNDSKTTNEDTPVNGKVTATDAEGDALTFTKGSNPTNGSVVVNIDGTYTYTPNADFNGKDSFDFIIKDG

SEQ ID NO: 177 - protein, 221 aa, Solitalea canadensis
TNGSVVVNADGTYTYTPNTNFNGTDSFTVKASDGKGGESTATVTITVTPVNDSPVANNDAKTTSEDVAVSGTVTATDVDGDALTFTKGSNPTNGTVTVNPDGAYTYTPNTNFNGTDSFTVKASDGKGGESTATVTITVTPVNDAPVAVNDAYSVNEDAVLTIAAKGVLTNDTDVENNTLTAVLVSGPTHGTLTLNADGSFTYTPTANYSGSDSFTYKANDG

SEQ ID NO: 178 - protein, 204 aa, Solitalea canadensis
YTYTPKPGFNGKDSFEIVVKDGKGGETKVIVDVTVSPVNDAPVASNDNKTTNEDTPVSGKITATDADGDAMTFIKGSNPSNGTVVVNADGTYTYTPNADFNGTDSFTVKVSDGKGGETTATITITVKAVNDAPVVTAGPVTTTENTPVSGKVTSTDADGDPLTAEKGTDPANGTVVVNPDGTYTYTPKPGFNGKDSFEIVVKDG

SEQ ID NO: 179 - protein, 93 aa, Solitalea canadensis
TASLTVTINVTPVNDAPVAINDAYSVNEDAVLTIAAKGVLTNDTDVENNTLTVVLVSGPAHGTLTLNADGSFTYTPTANFSGSDSFTYKANDG

SEQ ID NO: 180 - protein, 267 aa, Pedobacter agri
TAVVTITIQNSAPVVTAPAITTNEDTPVNGKITATDADGDPLTFTLVTPPAHGTLILNPDGTYTYTPNADYNGTDSFVVTVSDGKGGTTTVTINVTVTAVNDVPVATTPVNVTTTKNTPVTGKVTATDVDGDPLTYSVGTPPANGTVVVNPDGTFTYTPNNNYSGTDSFTIVVSDGKGGTTTVTVNVNIAPTNVAPVVTAPAITTNEDTPVNGKITATDADGDPLTFTLVTPPAHGTLVLNPDGTYTYTPNANYNGTDSFVVTVSDG

SEQ ID NO: 181 - protein, 68 aa, Pedobacter agri
AITTNEDTPVNGKITATDADGDPLTFTLVTPPAHGTLVLNPDGTYTYTPNANYNGTDSFVVTVSDGKG

SEQ ID NO: 182 - protein, 258 aa, Acaryochloris marina
TLSIGSVTDPSNGTLVDNNDGTYTYTPDANYTGPDAFTYTISDGNGGTDTATVNITVRSTNDPPVAVDDAVTTDEDVAITGNVLDGSSGGLDTDLDGDTLSVIDNTDPSNGTVSISANGDFTYTPNPDFFGTDSFGYTISDGNGGTSVATVNITVNPVNDAPIAADDTVTTDEDVAVVIDAALLLGNDTDIDGDTLSIDSVTTPSNGTLVDNNDGTYTYTPDANYTGSDAFTYTISDGNGGTDTATVNITVGSTNDIA

SEQ ID NO: 183 - protein, 252 aa, Cellvibrio japonicus
DQNLTTDEDTPVNGAIVASDADGDTLGYSVTTNPTNGTVVLNATTGTFTYTPNADYHGSDSFVVTISDGNGDTTTSTVTIGVNPVNDAPVSADQNLTTDEDTPVNGAIVASDADGDTLGYSVTTGPTNGTVVLNATTGTFTYTPNANYNGSDSFVVTISDGNGGTTTSTVTIGVNPVNDAPVSADQNLTTDEDTPVNGAIVASDADGDTLGYSVTTGPTNGTVVLNATTGTFTYTPNADYHGSDSFVVTISD

SEQ ID NO: 184 - protein, 206 aa, Cellvibrio japonicus
FTYTPNANYNGSDSFVVTIDDGNGGTTASTITIGVTPVNDAPVSSDQNLTTDEDTPVNGAIVASDADGDTLGYSVTTNPTNGTVVLNATTGTFTYTPNADYHGSDSFVVTISDGNGDTTTSTVTIGVNPVNDAPVSADQNLTTDEDTPVNGAIVASDADGDTLGYSVTTGPTNGTVVLNATTGTFTYTPNANYNGSDSFVVTISDG

SEQ ID NO: 185 - protein, 253 aa, Cellvibrio japonicus
DQNLTTDEDTPVNGAIVASDADGDTLGYSVTTGPTNGTVVLNATTGTFTYTPNANYNGSDSFVVTISDGNGGTTTSTVTIGVNPVNDAPVSADQNLTTDEDTPVNGAIVASDADGDTLGYSVTTGPTNGTVVLNATTGTFTYTPNADYHGSDSFVVTISDGNGGTTTSTITIGVTPVNDAPVSADQNLTTPEDTPVDGTIIATDIDGDVLSYSVSTLPVNGTVTLNPATGEFTYTPNANYNGSDSFVVTIDDG

SEQ ID NO: 186 - protein, 274 aa, Cellvibrio japonicus
GNTSTAVITLNVTPVNDAPTTSDISLTTDEDTSVSGQVNASDVEGDTLGYSVTTNPTNGTVVLNATTGTFTYTPNADYHGSDSFVVTISDGNGGTTTSTVNIGVTPVNDAPVSSDQNLTTAEDTPINGTITATDVDGDVLSYIVSTLPANGTVTLNPATGEFTYTPNADYHGSDSFVVTISDGNGGTTTSTVIIGVTPVNDAPVSSDQNLTTDEDTPVNGAIVAGDADGDTLGYSVTTNPTNGTVVLNATTGTFTYTPNADYHGSDSFVVTISD

SEQ ID NO: 187 - protein, 253 aa, Cellvibrio japonicus
DQNLTTDEDTPVNGAIVASDADGDTLGYSVTTGPTNGTVVLNATTGTFTYTPNADYHGSDSFVVTISDGNGGTTTSTITIGVTPVNDAPVSADQNLTTPEDTPVDGTIIATDIDGDVLSYSVSTLPVNGTVTLNPATGEFTYTPNANYNGSDSFVVTIDDGNGGTTASTITIGVTPVNDAPVSSDQNLTTDEDTPVNGAIVASDADGDTLGYSVTTNPTNGTVVLNATTGTFTYTPNADYHGSDSFVVTISDG

SEQ ID NO: 188 - protein, 206 aa, Cellvibrio japonicus
FIYTPNPDFNGSDSFTVVVTDNHGNTSTAVITLNVTPVNDAPTTSDISLTTDEDTSVSGQVNASDVEGDTLGYSVTTNPTNGTVVLNATTGTFTYTPNADYHGSDSFVVTISDGNGGTTTSTVNIGVTPVNDAPVSSDQNLTTAEDTPINGTITATDVDGDVLSYIVSTLPANGTVTLNPATGEFTYTPNADYHGSDSFVVTISDG

SEQ ID NO: 189 - protein, 150 aa, Cellvibrio japonicus
DQNLTTDEDTPVNGAIVASDADGDTLGYSVTTGPTNGTVVLNATTGTFTYTPNADYHGNDSFVVTISDGNGGTTTSTVTIGVTPVNDVPVAADDYFVIDEDTPLVVSPSQLLANDSDVDGDTLTVVTIQSATNGTLSVVGGNIVFTPTPD

SEQ ID NO: 190 - protein, 237 aa, Pseudomonas denitrificans
YTYTPGQNFNGNDSFTVIVDDGQGGRDTLTVNVGVNPVNDAPVAQDDGPLPVAEDTVTTGNVLSNDSDVDGDTLTVTGFTFGGNSYGAGQTATLNGVGSLVINADGSFTFTPAKDYNGPVPSATYTVSDGNASDSAQLSFDNVSPVNDAPVTADQSNTTAEDTPVSGRIIATDADQDTLSYTLKPGAEPTHGTLVLNPATGEYTYTPDTDYNGGDSFTVVVNDGNGGTVESVVSIDV

SEQ ID NO: 191 - protein, 103 aa, Pseudomonas denitrificans
VNATATESSNGDKATTSLPLEIQVHPLNDVPTATQQNIAINEDDVLNGQIVANDVDHDSLSYTVKTGTTHGVLMLDGKTGAYTYTPAANYSGPDSFTVTVSDG

SEQ ID NO: 192 - protein, 177 aa, Pseudomonas denitrificans
DQSNTTAEDTPVSGRIIATDADQDTLSYTLKPGAEPTHGTLVLNPATGEYTYTPDTDYNGGDSFTVVVNDGNGGTVESVVSIDVTPVNDAPETADQSRTTAEDTPITGQIVATDADRDTLSYTLKPGSEPAHGTLVLNPATGEYTYTPGTDYNGSDSFTVVVNDGNGGTVESVVSID

SEQ ID NO: 193 - protein, 188 aa, Pseudomonas denitrificans
GNGGTVESVVSIDVTPVNDAPETADQSRTTAEDTPITGQIVATDADRDTLSYTLKPGSEPAHGTLVLNPATGEYTYTPGTDYNGSDSFTVVVNDGNGGTVESVVSIDVTPVNDAPVAQDDGPLSVTEDTATTGNVLGNDSDVDGDTLTVTDFTFDGNSYNAGQTATLNGVGSLVINADGSFTFTPAKD

SEQ ID NO: 194 - protein, 55 aa, Pseudomonas denitrificans
GQLRADDPDGNPLRFELDDGPRNGTVVVNADGSYTYTPGQNFNGNDSFTVIVDDG

SEQ ID NO: 195 - protein, 55 aa, Pseudomonas denitrificans; identical to SEQ ID NO: 194

SEQ ID NO: 196 - protein, 257 aa, Chlorobium luteolum
TIDATTGAWSYAPTADYNGSDSFTVSVTDGDGNVETQVISVTVAAVNDAATFSGDKTGSGNEDGTITGTLAVADAADGLASPLDFSVSTAASNGTATIDATTGAWSYAPTADYNGSDSFTVSVTDGDGNVETQVISVTVAAVNDAATFSGDKTGSGNEDGTITGTLAVADAADGLASPLDFSVSTAASNGTATIDATTGAWSYAPTADYNGSDSFTVSVTDGDGNVETQVISVTVAAVNDAATFSGDKTGSGNEDGT

SEQ ID NO: 197 - protein, 248 aa, Chlorobium luteolum
SYQGALNYNGSDTLTMLTTDGSLLTDSDTVSITVAAVNDAATFSGDKTGSGNEDGTITGTLAVADAADGLASPLDFSVSTAASNGTATIDATTGAWSYAPTADYNGSDSFTVSVTDGDGNVETQVISVTVAAVNDAATFSGDKTGSGNEDGTITGTLAVADAADGLASPLDFSVSTAASNGTATIDATTGAWSYAPTADYNGSDSFTVSVTDGDGNVETQVISVTVAAVNDAATFSGDKTGSGNEDGT

SEQ ID NO: 198 - protein, 209 aa, Rhizobium sp. 2MFCol3.1
YSFTPDRNFNGTDQFSYSVSDGRATVVYRVFVTVTPVNDAPVGSDTAISLAEDTTFTGRLPTASDADGDAITYGLAAAAGHGTVSINADGTYSYTPNGNFNGTDSFSYSVSDGTVTNIYRVTVTVTAVNDAPVGSDTSISVQEGTVATGTLPPAFDVEGSPVTYGLGANPVHGTVTIDLNGNYTYQPDAGFSGADQFTYTVSDGTATSV

SEQ ID NO: 199 - protein, 204 aa, Rhizobium sp. 2MFCol3.1
YTYRPNANYNGTDSFTYTVSDGIDQSTYTVSITVTPVNDAPVGSNTAITVSEDVPFDGVLPAASDVDGDPVRYAVGTQPMHGSVTVNPDGTYRYVPAADYNGTDSFTYQVTDGQAVSTYTVAITVTAVNDAPVGSNVSISVDEDGSASGTLPRAVDADGDPLTYLLQNGPSHGVATVQSDGRYTYVPAANFSGTDTFTYAVSDG

SEQ ID NO: 200 - protein, 283 aa, Rhizobium sp. 2MFCol3.1
PTNGVLSLGGTAVTAGQVISAANLGNLTFTPAANANGTALASFTFQVRDNGGTANGGQDTDQSPNSFTFNVTAVNDAPVNTLPASFGTNEDTALSLAGLQVSDVDAGSGSIIVTLRVNSGTLAATGGSGVTVSGSGSGTLVLTGTLSNINGFLAAAGTRPVFNPAANANGAVTLTMVTNDNGNTGSGGALSDTDTATISVAPVNDAPVGSDTAITTNEDTAFSGTLPVATDVDGDSLTYGAGSIAPSHGTVVVNPNGTYTYTPSANFNGADSFTYSVTDGTVT

SEQ ID NO: 201 - protein, 205 aa, Rhizobium sp. 2MFCol3.1
YSYVPAANYNGSDSFTYTVSDGQATSTYTISITVTAINDAPVSSGTSISTEEDETVTGQLPAATDADGDPITYGLAAQAANGTVVINPDGSYSYTPAPGYNGSDSFSFSVSDGRDSTTYVVNVTVGAVNDPPSGSNAAITVAEDGLASGTLPLATDPDGDPLTYGLGAPAAHGTVTVNTDGSYTYRPNANYNGTDSFTYTVSDGI

SEQ ID NO: 202 - protein, 219 aa, Rhizobium sp. 2MFCol3.1
GTVSINADGTYSYTPNGNFNGTDSFSYSVSDGTVTNIYRVTVTVTAVNDAPVGSDTSISVQEGTVATGTLPPAFDVEGSPVTYGLGANPVHGTVTIDLNGNYTYQPDAGFSGADQFTYTVSDGTATSVYTVTVSVGVANGAPVGSDATLTIAEDTTFTGTLPAATDPDGDPLSYAVAAGPAHGVVTITADGRYVFTPNGNFNGTDQFSYSVSDGRATVV

SEQ ID NO: 203 - protein, 219 aa, Rhizobium sp. 2MFCol3.1
GTVSINANGTYSYIPDSNFNGTDSFSYSVSDGTATNVYRVSVTVSAVNDAPIGSDTSISAQQGTIATGNLPPAYDIEGSPVTYGLGAQAAHGTVVIGANGSYSYQPNSGFSGSDQFTYTVSDGTAVSIYTVTVSVGAVNSAPSGQDTTLTVSEDTPFTGQLPVATDADGDALTYGLAAGPAHGVVTVSANGQYSFTPDRNFNGTDQFSYSVSDGRATVV

SEQ ID NO: 204 - protein, 217 aa, Rhizobium sp. 2MFCol3.1
TFTPAANYNGSPSFTYTVSDGNGGTATATVSGSVTPVNDAPVAVNDSFTTPEDTAVTFDVRGNDSDVDGDALNVTAINGTAIASGGSVAITGGSVRLNANGTLTFTPAANYNGTPSFTYTISDGNGGTATATVNGTVTPVNDAPVASDTTVSVDEDGVISSTLPTATDVDGDAITYAAGSTTPAHGTVVVNPNGTYSYTPSANFNGTDRFTYVVSDG

SEQ ID NO: 205 - protein, 219 aa, Rhizobium sp. 2MFCol3.1
GTVVIGANGSYSYQPNSGFSGSDQFTYTVSDGTAVSIYTVTVSVGAVNSAPSGQDTTLTVSEDTPFTGQLPVATDADGDALTYGLAAGPAHGVVTVSANGQYSFTPDRNFNGTDQFSYSVSDGRATVVYRVFVTVTPVNDAPVGSDTAISLAEDTTFTGRLPTASDADGDAITYGLAAAAGHGTVSINADGTYSYTPNGNFNGTDSFSYSVSDGTVTNI

SEQ ID NO: 206 - protein, 138 aa, Rhizobium sp. 2MFCol3.1
SIAGSAGGRFVIGTDGSYTFVPGADFDNLKAGEQRTTSITYTISDGQGGTSTATFTVTVSGANDLPVGSDIAVSTAEDTALSGQLPAATDVDGDPLTYGVGSQPAHGSVTIDPTGAYVYTPTADFNGADSFTYTISDG

SEQ ID NO: 207 - protein, 283 aa, Rhizobium sp. 2MFCol3.1
VTVNDGAANSNVAVATVNVIAVNDAPVNTVPTSVTLSEDVQTAISGISVSDVDSGSVTVTLSVANGTLSPSVIAGTVTGNGTASVTVSGTLAQVNSVLASLRYTGRADYNGSDTLVVSTSDGSLTDTDNVAITVTPVADITPDTVATAEDTAITFNVITGTNGATADTFKDPGRAVTSVTQPPAGQGSVTFAADGTLVYTPSANFNGQTAFTYTVTAGGVTETATVTVNVSAVNDAPVNSLPASGWSTSEDTSIALSGLSISDVDAGTGTMTVTLAVSGGTVS

SEQ ID NO: 208 - protein, 237 aa, Rhizobium sp. 2MFCol3.1
IQTREDVPVSGVVAATDPDGDPLTYAVATGPRNGTVVIDAAGRYLYSPNTDFNGTDSFDISVSDGQGGVTTVTIAVTVTPVNDAPVGSDATATVAEDQTLNGQLPVATDVDSPSLTYGLGGQAAHGTVTVNPNGTYSYVPAANYNGSDSFTYTVSDGQATSTYTISITVTAINDAPVSSGTSISTEEDETVTGQLPAATDADGDPITYGLAAQAANGTVVINPDGSYSYTPAPGYNG

SEQ ID NO: 209 - protein, 262 aa, Rhizobium sp. 2MFCol3.1
TAINGSAIVANGVVNVTSGTVRLNADGTLTFTPSANVNGSTSFTYTVTSGGVTETATVNVTIVPVNDAPVNTVPGAQTVAEDTPLAVSGVSVADVDGDVLTTTVTVTNGIANVTTGTGATIANNGTSSVRLSGTAAQINAALAGLTYTATADYNGAAQLTVVTTDGSLTDTDTVAITITPVADIVADNLTTNEDTAITFNAITGTNGASADNFENAGRAITSVTQPPAGQGTVTFAADGTITYTPAANFNGTTSFTYTVTSG

SEQ ID NO: 210 - protein, 209 aa, Rhizobium sp. 2MFCol3.1
YTYVPAANFSGTDTFTYAVSDGTVLSVYTVTVNVGAENDAPTGSDLAISISEDTSFTGSLPSASDADGDTIVYGLGTPAAHGAVTVNPDGTFSYVPQANYAGPDQFTYTLFDGTVTVTYTVTIDVQGVNDAPIGADTAISLAEDTPFSGQLPPAVDPDGDPVTYALAGAASHGTVSINANGTYSYIPDSNFNGTDSFSYSVSDGTATNV

SEQ ID NO: 211 - protein, 89 aa, Rhizobium sp. 2MFCol3.1
TANATLSVTVVGVNDAPIGSDGSFQTAEDTVATGFLPTASDPDGDALTYAIATPPANGVVTISADGSYRYTPPANFNGSDSFTYSVSDG

SEQ ID NO: 212 - protein, 122 aa, Rhizobium sp. 2MFCol3.1
FTYTPTAGFNGTDSFVYRIDDGNGGTDTATVTITINPVNDAPVVVNDNFTVAEDGQVVIPVLANDSDPDGDALTITEINGQPISVGGSVALVSGTVTLNSDGTLTFAAAPDFAGNASFTYTL

SEQ ID NO: 213 - protein, 239 aa, Rhizobium sp. 2MFCol3.1
TYAAGSTTPAHGTVVVNPNGTYSYTPSANFNGTDRFTYVVSDGKGGSNEYTVTVNVASVNDVPVGTPLPARSGADGAAVTFDVSGFFTDADNDTLTYSASGLPVGLSINAAGVVTGTIDRQASVGGPTGNGVYTVTISVSDGHGGTASQSFSFSVSNPPPIAVNDAVTATEDTPLTFNVLDGSASGGVPDSDPDGDPLTVTAASAANGTVTLGSGGQITYQPNANFNGTDTITYTISDG

SEQ ID NO: 214 - protein, 61 aa, Rhizobium sp. 2MFCol3.1
NGQLPVATDVDSPSLTYGLGGQAAHGTVTVNPNGTYSYVPAANYNGSDSFTYTVSDGQATS

SEQ ID NO: 215 - protein, 58 aa, Rhizobium sp. 2MFCol3.1
VANGNGPDTDPDNDPLTVSLVTNTAHGALVLNPDGTFTYTPTAGFNGTDSFVYRIDDG

SEQ ID NO: 216 - protein, 236 aa, Dickeya dadantii
STLTYTPNAGYFGVDTITYTIADSKGLSALLPGTVAVTVNSLPTLSLPVLVNLFNEDTPIVFANVLGTKISIGDLDGSIARISLSVPLGSLTLSQTANLSFSQGDGINDSNITMQGNIADINAALNGLIYTPDADYNGPVTITIGLTDTLLAIPITATLPIGIAPVADIVSDSVITNVSSPVSFNVMANDTFENINARVTSYSTPSHGTVVIDSTGNAVYTPNSGYLGNDSFTYTV

SEQ ID NO: 217 - protein, 205 aa, Dickeya dadantii
TYTPAANYNGSDTITYKISDGLGASATGTVTVTITPVNDAPVAVNDTATTLEDTSVTVNVLANDSDVDGDSLTVTAATAGHGTVVINANGTLTYTSAANYNGSDTISYTVSDGHGGTATATVAVTITPVNDAPVAANDTATTLEDTPVTVNVLANDSDVDGDSLTVTAATAGHGTVVINANGTLTYTPNANFNGSDTISYTVSDG

SEQ ID NO: 218 - protein, 205 aa, Dickeya dadantii
TYTPNANFNGTDTVTYTVSDGAGGVVTGTLTITVTAVNDAPVVSADTATTAEDTPVTVDVLANDSDVDGNPLTVTAATAGNGTVVINADGTLTYTPNSNFNGTDTVTYTVSDGHGGTATATVVITVTPVNDAPVAANDSATTAEDTPVTVDVLANDSDVDGNPLTITAATAGNGTVVINADGTLTYTPNSNFNGTDTVTYTVSDG

SEQ ID NO: 219 - protein, 205 aa, Dickeya dadantii
TYTPAANYNGSDTISYTVSDGHGGTATATVAVTITPVNDAPVAANDTATTQEDTPVIVNVLSNDSDVDGDSLTVTAATAGHGTVVINANGTLTYTPAANYNGSDTISYTVSDGHGGTATATVVITVTPVNDAPVAANDSATTAEDTPVTVNVLSNDSDVDGDSLTVTAATAGHGTVVINANGTLTYTPAANYNGSDTLSYTVSDG

SEQ ID NO: 220 - protein, 219 aa, Dickeya dadantii
TYTPNANFNGTDTVTYTVSDGAGGVVTGTLTITVTAVNDAPVAGADTATTAEDTPVTVDVLANDSDVDGNPLTVTAATAGNGSVVINADGTLTYTPNSNFNGTDTVTYTVSDGQGGVVTGTLTITVTAVNDAPEVIGETTLNTSVNTPVSVNVLDNSRDVDGDPLTVTSISVTNGRVLVNAGGMMTYIPNPGFSGTDVVSYTLSDPEGSTVRGTLTVVV

SEQ ID NO: 221 - protein, 205 aa, Dickeya dadantii
TYTPNANFNGTDTVTYTVSNSQGGLATGTLTITVTAVNDAPVAGADTATTAEDTPVTVDVLANDSDVDGNPLTVTAATAGNGTVVINADGTLTYTPAANFNGTDTVTYTVSDGAGGVVTGTLTITVTAVNDAPVAGADTATTAEDTPVTVDVLANDSDVDGNPLTVTAATAGNGAVVINPDGTLTYKPNSNFNGTDTVTYTVSDG

SEQ ID NO: 222 - protein, 205 aa, Dickeya dadantii
TYTPAANYNGSDTLSYTVSDGHGGTATATVTVTVTAVNDAPVAVNDTATTLEDTPVTVNVLANDTDVDGDSLTVTAASAGHGSVTINADGTLTYTPNANFNGTDTVTYSVSDGAGGVATGMLTVTVTAVNDAPVTGADMAATSQNTPVTVNVLSNDSDVDGDSLTVTAASAGHGSVVINADGTLTYTPNTNYSGSDTVTYTVSDG

SEQ ID NO: 223 - protein, 86 aa, Dickeya dadantii
GSVVINADGTLTYTPNSNFNGTDTVTYTVSDGQGGVVTGTLTITVTAVNDAPEVIGETTLNTSVNTPVSVNVLDNSRDVDGDPLTV

SEQ ID NO: 224 - protein, 350 aa, Novispirillum itersonii
NSNSTLTLKGNNFALSPGDSELSPGRVTGNGTLDGSQLSSFVLSGILRPGDYVNTEAFPSIVNGIGTLRLKGDAWFTEDTVVIARAGSTGADGLAFDGGLHLAGTLQMTFTSAPLSPISFISATPNGLTDTLSGTFNRLDFRGIGSGLLIDPAYNTTTKTLTLTAITTGITTTTIGGEVADYVWNDEGNGDFSISGADVVYGNAGDDIFRISTSDTSFHLLDGGEGVDTLKINAGGTTIDLSNLIGRVQAMDVIDISDTNTGKLTILDAATVRSFNAGVDITDGTPVHSNYNPISGQHNTLFITGNGDDTLHLKDPSSWVSKGSIAYEVNGSAQTFRHYTADNGETHLYV

SEQ ID NO: 225 - protein, 233 aa, Novispirillum itersonii
NSGALTLIDATGTLSPLWNDIHYSGVDATQMFRPYIDGNDLKVEIITSGITTGSLLSDDGNANYVYAEAGADNFLVHGADVIFGNDGDDVFQVLDHDAATGRPAFSFLDGGSGTNELLIDGHATSYNLDLYAPWIQNFDVISLLNDNNSDSAFISADAVRSILGDKTTSDLAGVGNALIIKGETGDHLSLVSATGTGWAADSNVPEIAGYTGYTSTNTAGDEVHLYIQNNISV

SEQ ID NO: 226 - protein, 101 aa, Asticcacaulis biprosthecium
TDTVSGVENIEFADGTFAIAAILQVAPVAASQAIGNGVEGEVITGAIAATDAENDALTYSIVSGPAHGTITAFDAATGAFTYTPDAGYYGPDSFTFRANDG

SEQ ID NO: 227 - protein, 318 aa, Chitinophaga pinensis
TYAIGTTTPANGSVTVNADGTFAYTPNADYVGTDAFTVVISDGNGGTTTVTVNITVTAVNDAPTGTNQNLTTPEDTPLNGAVVGADADGDPLTYAIGTTIPANGSVTVNADGTFVYTPNADYVGADAFTVVISDGNGGTTTVTVNITVTAVNDAPTGTDLNLTMAEDNPLNGTVVGVDADNDPLTYVIGATNPANGIVTVNTDGTFVYIPNPNFNGIDAFTVVISDGNGGTATVTVNITVTPVNDAPTGTGDTRTTPRNTPVNGAVSGTDVDGDVLTYTLGTPPANGTAVVNTDGTYTYTPNAGYSGPDSFTIIISDG

SEQ ID NO: 228 - protein, 285 aa, Chitinophaga pinensis
NYSDPDGAPLNSIRITSLPLNGSFRLNGTVITVGQDIPAAQLGNITFIPTANWSGTTGFDWRAYDGTSFSAGTSHVTINIQPANDAPQITTPTSIAVTEDIPASLKDISFSDIDAGTGVVTVTFSVPNGTLNATSGAGVTVSGTPAALILTGTIADINAFLVANRVNYSSTQNPPPTVILTVNISDNGNTGAGGAQQATATVPLGITAVNDAPTGTGDTRTTAEDTPVNGAVTGNDVDGDVLTYTLGTPPTNGTATVNASTGAYTYTPNPNYNGPDMFTVVISDG

SEQ ID NO: 229 - protein, 214 aa, Chitinophaga pinensis
TVNASTGAYTYTPNPNYNGPDMFTVVISDGHGSSVTVTVNITVTAVNDAPTGTGDTRTTLEDTPVNGAVSGADVDGDALTYTLGTAPTNGLATVNATTGAYTYTPNPNYNGPDVFTVVISDGHGGSVTVTVNITVTAVNDAPTGTGDTRTTLEDTPVNGAVSGADADGDALTYTLGTAPTNGLATVNATTGAYTYTPNPNYNGPDAFTVVISDG

SEQ ID NO: 230 - protein, 227 aa, Chitinophaga pinensis
TYAIGTTTPANGSVTVNADGTFIYTPNADYVGTDVFTVVISDGNGGTATVTININVTAVNDAPTGANQNLTTPEDTPLNGAVVGADADGDALTYAIGTTTPTNGSVTVNADGTFIYTPNADFNGADAFTVVISDGNGGTTTVTVNITVTAVNDAPTGTNQNLTTPEDTPLNGAVVGADADGDALTYAIGTTTPANGSVTVNADGTFAYTPNADYVGTDAFTVVISDG

SEQ ID NO: 231 - protein, 227 aa, Chitinophaga pinensis
TYATGTTTPANGSVTVNADGTFIYTPNADYVGTDAFTVVISDGNGGTATVTININVTAVNDAPTGANQNLTTPEDTPLNGAVVGADADGDPLTYAIGTTTPTNGSVTVNADGTFVYTPNADFNGTDAFTVVISDGNGGTTTVTVNITVTAVNDAPTGANQNLTTPEDTPLNGAVVGADADGDALTYAIGTTTPANGSVTVNADGTFIYTPNADYVGTDAFTVVISDG

SEQ ID NO: 232 - protein, 214 aa, Chitinophaga pinensis
TVNATTGAYTYTPNPNYNGPDAFTVVISDGNGGSVTVTVNITVTAVNDVPTGADQNLTTPEDTPLNGAVVGADADGDALTYAIGTTTPANGSVTVNTDGTFIYTPNADYVGTDAFTVVISDGNGGTATVTININVTAVNDAPTGTNQNLTTPEDTPLNGAVLGVDADGDALTYAIGTTTPTNGSVIVNTDGTFIYTPNADYVGTDAFTVVISDG

SEQ ID NO: 233 - protein, 227 aa, Chitinophaga pinensis
TYAIGTTTPTNGSVTVNANGTFVYTPNADFNGTDAFTVVISDGNGGTTTVTVNITVTAVNDAPTGANQNLSTPEDTPLNGAVVGADADGDALTYATGTTTPANGSVTVNADGTFIYTPNADYVGTDAFTVVISDGNGGTATVTININVTAVNDAPTGANQNLTTPEDTPLNGAVVGADADGDPLTYAIGTTTPTNGSVTVNADGTFVYTPNADFNGTDAFTVVISDG

SEQ ID NO: 234 - protein, 180 aa, Chitinophaga pinensis
YTYTPNTGYAGPDSFTIIISDGNGGTVTVTVDIMMITVVPNPAIALVKVGARDKNDITYITATVTGLTPADATVTDISGTSLNNDTPTETTVPAPPQANDDQAETRASIAVVIPVLDNDDPVESTFSIPSLTITSIPKHGQVTINEDGSIRYMPDNGYTGEDDFSYQVSDVDGYITNIAV

SEQ ID NO: 235 - protein, 318 aa, Unknown
  uncultured bacterium - accession no. emb|CAX84233.1|
QFGLLTLAGREGLTFVAGDGLQDGKMVFTGTLAVVQKALAGLSYQGAGDFNGSDRLTLSTDDQGATGTGGALVTTDAVAITVGAVNDAPVNTVPAAQTVNEDTSLALTGLAITDGDDGGGTLQVTLSVGQGVLTLAQTSGLTFTTGDGTSDATLVFTGTKSNINSAIGTVTYLGASNYNGSDTLTLTTSDQGNAGSGGTLTDTDTVAITVSAVNDAPVNTVPAAQTVNEDTNLSLTGLAITDGDDGGGTLQVTLSVGQGVLTLAQTSGLTFTTGDGTSDATLVFTGTKSNINSAIGTVTYLGASNYNGSDTLTLTTSD

SEQ ID NO: 236 - protein, 210 aa, Unknown
  uncultured bacteriium - accession no. emb|CAX84233.1|
TLAITDVDDGGGTMQVTLSVGQGVLTLAQTTGLTFTTGDGTSDATLVFTGTKSAINSAIGTVTYLGSTNYNGSDTLTLTTSDQGNAGSGSTLTDTDTVAITISAVNDAPVNTVPAAQTVNEDTNLTLTGLAITDVDDGGGTMQVTLSVGQGVLTLAQTTGLTFTTGDGTSDATLVFTGTKSAINSAIGTVTYLGSTNYNGSDTLTMTTSD

SEQ ID NO: 237 - protein, 173 aa, Cyanothece sp. PCC 7822
YTPNANFNGTDSFTYRISDGNGGTSTATVNVTVNPVNDAPVAVNNSATTNEVYTPNANFNGTDSFTYRISDGNGGTSTATVNVTVNPVNDAPVAVNNSATTNEDTAVSIGVLSNDTDVEGNPLSIDSFTQGNSGTVTLNNNGTPGDTTDDLLVYTPNANFNGTDSFSYTISDG

SEQ ID NO: 238 - protein, 222 aa, Cyanothece sp. PCC 7822
YTPNANFNGTDSFSYTISDGNGGTSTATVNVTVNPVNDAPVAVNNSATTNEDAAVSIGVLSNDTDVDGNPLSIDSFTQGNSGTVTLNDNGTPGDTTDDLLVYTPNANFNGTDSFTYRISDGNGGTSTATVNVTVNPVNDAPVAVNNSATTNEDTAVSIGVLSNDTDVDGNPLSIDSFTQGNSGTVTLNNNGTPGNTTDDLLVYTPNANFNGTDSFTYRISDG

SEQ ID NO: 239 - protein, 329 aa, Methyloversatilis universalis
AGSRIAGAVLSSNGGSLRADSGTLLLNAGESAQIASGTFELSGATLTATGNSSLDGAGTFSFTSGTINGPGTLIVNTATDWSGGNMAGSGITRLAGAARILSGSTRGLGRTLEIAGSTVASNLSGAVQIQDGARISVLSGGTLELNNSAVFSHLGSGRIDNAGLLLKTGSDSASLAMPVGNTGTLRVAEGSLSANGFTTNAGTLDLRAGSMLTTGSLQNNGVIQGSGTINLGAGTLTNAGIVRPGDASGTGTLTVTGQFVQTAGGRIEADVLGATAAQQDHLVVSGSAQLDGALVLTPANGLTFGASDRYTVLSCGADGCLSGAFASVN

SEQ ID NO: 240 - protein, 247 aa, Methyloversatilis universalis
LAGTQTIAAGARIDIDGGRTRLASSAVVSGAGPLRLTGGVLAMDDGMTTGITLRHTNAAGSSSIYKTGGYLYVSNGATFTNAAGAALYIDTAGGNSGVWYGGTAGSFVNDGLLVKQGNGTFNFWNPVRLSNTGTLTVAQGTLFADNFTSNSGTLHTLSGAVLNTGNTALTNTGTVSGHGTLVIGGTGLLNRGIVAPGGSNEDGTLRITGHYTQAADGTLQIERGTPGTDALVVSGTATLGGTLTVSS

SEQ ID NO: 241 - protein, 305 aa, Roseovarius sp. TM1035
GYTYTPDADFNGTDAFTVSVTDGNGGTDTVVVNVTVNAVNDAPVAQADAAISTGEDQAISGTVTATDVDGDSLSFALATGGAPANGSVTISANGGYTYTPDADFNGTDAFTVSVTDGNGGTDTVVVNVTVNAVNDAPVAQADAAISTGEDQAISGTVTATDVDGDSLSFALASGGAPANGSVTISANGGYTYTPDADFNGTDAFTVSVTDGNGGTDTVVVNVTVNAVNDAPVAQADAAISTGEDQAISGTVTATDVDGDSLSFALATGGAPANGSVTVSANGGYTYTPDADFNGTDAFTVSVTDG

SEQ ID NO: 242 - protein, 97 aa, Roseovarius sp. TM1035
VSDGLLTATASATLDLLPVNDAPVAQADAAISTGEDQAISGTVTATDVDGDSLSFALASGGAPANGSVTISANGGYTYTPDADFNGTDAFTVSVTDG

SEQ ID NO: 243 - protein, 120 aa, Roseovarius sp. TM1035
QFDFLAAGEVLSITYTVTVEDNNGGTDTQDITFTITGTNDLPVIDVAESDVEISGDEDAVGISGTVLATDVDGDELSFALADGGSPENGSVTVNTDGTYTYVPNADFNGTDAFTVAVSDG

SEQ ID NO: 244 - protein, 287 aa, Methylobacterium sp. GXF4
VASGATLDLAGFDQGIGSLAGAGRVSLGAGTLTAGADNSSTAFSGTITGSGGLAKAGTGTLTLSGSNSYSGGTALLGGTLAIAADASLGASAGGLRFDGGTLVTTASLAMARPVTLAGDARLRPASGTSLTLNGSVTGPGGLVQDGEGTTILAGRNTYAGATTVAGGTLQIDGVLSASEVTVRRGGTLAGSGKIGDPLIEAGGRLAPGSAAAIGTLSIHGPLTFAAGSFYTVKLTPAANDRTDVTGPVALQGGTVQVLAGAGTYTPALRYTLLTATDGVTGRFSALQ

SEQ ID NO: 245 - protein, 134 aa, Rhodopirellula baltica
TPETIYLTVTDVNDAPEVTGPATATVAEGGSLTFDLGDAGVIDTTDVDGDILTVTLTANHASIALAQTTGLTLIDNDGSDGTLQFSGSVADIDAALYGLDYDSQAGYNGSASLVVLVDDGNLTDSTTVAITVNP

SEQ ID NO: 246 - protein, 300 aa, Sphingomonas sp. MM-1
GGFNLAGGTIAISTNAALGNGILHVTGDASLSGSLADLYVVNAINLDAGKTLDLNGGNDLTITGMISGGGNLRISNASVTLLGANSHAGATTISSGSTLYANATGALSNLSAITVDTGGRLDLGNDDQTIGALAGAGSVTSGGPGRVLTTGGDNSSTIFAGDLQNGAGTLGITKIGSGTMTLSGTANSYTGATLVSGGTLNVNGSIASSSLLTVASGARLAGSGTVGSTTVQSGGRIAPGNSIGTLNVAGDLTLASGSILDFELGSPGAAANPAAGTSDRIAVSGNLVLDGIINLGQSGT

SEQ ID NO: 247 - protein, 326 aa, Methyloversatilis universalis
LAGTQTIASGARIEVIGGTTRLASGATVSGAGPLRLTGGVLAMDDGMSTGITLQQSGGTLSGAGSNTLSGRYEWTGGTVGGSGTLTVSGALQISGSGSFGLDGRSLRHTNAAGSSALYKTGGYLYVSNGATFTNAAGAALYIDTAGGNSGVWYGGTAGSFVNDGLLVKQGNGTFNFWNPVRLSNTGTLTVAQGTLFADNFTSNSGTLHTLSGAVLNTGNTALTNTGTVSGHGTLVIGGTGLLNRGIVAPGGSNEDGTLRITGHYTQAADGTLQIERGTPGTDALVVSGTATLGGTLTVSSLSGYTPTAVQSDIVSAGTLTGSFATV

SEQ ID NO: 248 - protein, 105 aa, Azospirillum sp. B510
VTLGVLHGTLTLSGTTGLSFTTGTGTANASMVFTGTISAINTALAGLSYAPTANYHGSDTLTITTNDRGNTGADPGTTGDGSSEQDQDTVAITVNPVADTPSVTG

SEQ ID NO: 249 - protein, 359 aa, Burkholderia ambifaria MC40-6
VINNGTFDISGTTSGATINALTGTGTVALGDRTLTLANAAGTFSGAIGGTGGLTVAGGTQTLSVANGYTGATSISAGTLALSGAGSIAASSGVINNGTLDISGTTSGATVNALTGTGTVALGGRTLTLANAAGTFSGAIGGTGGLTVAGGTQTLSGVNTYTGATMVHAGTLALSGAGRLASSTSVTLAGATAALDLSAVGNQTVAHLSGVAGSRVVLGGSALTLSDDSSQTFGGSLGGTGGLVKQGAGTLTLNGVSSAFSGTTTVAGGTLAVGDAANAGAVLGGNVLVSSLGTLRGHGTVSGDVSSSGVVAPGGSIGTLSVGGNYTQAAGGTLSIEVSPTEASQLRVSGTATLNGSLAV

SEQ ID NO: 250 - protein, 232 aa, Nostoc punctiforme PCC 73102
VNDGAANSTAVTRNINITVVNDAPIATATNSALAYIENAITVIDSAITVSDVDSANLSSATVNISSGFVSTQDILAFTNQNGITGSYNSSTGILTLSGSSSVANYQTALRSITYTNSSDNPTLTPRTISFIVNDGTANSTAVTRNINITAVNDAPVAVNDSITTNKNTPIIINATTLLSNDTDVDVSDVLSITGFTQPSQGSLVNNNNGTYTYTPVQNYYGSDSFTYTISDG

SEQ ID NO: 251 - protein, 55 aa, Pseudomonas chlororaphis
LQVGDRSTPSVFAGQVTVANGAALSGNGSVGSLDNHGLTQSGGTAGTLSVAGNLS

SEQ ID NO: 252 - protein, 179 aa, Bradyrhizobium sp. WSM471
GNVTVDANGKLTVNGATISGGTIDGLGTIDVTSASKIDGGATLSTATVTADAKLTLDGITVSGSTITDNGGIELDNTVKLKDGASIQGGAVANTGTLKITGAATLLNDVVTNTGTVSVDGGQTLTLSGTEISGGAVNGAGAIDVIGSSKIDQSATLSTSAVTVESGVILTLDDVTVAGT

SEQ ID NO: 253 - protein, 308 aa, Burkholderia ambifaria AMMD
GLTVAGGTQNLSGANGYTGATSISAGTLALSGAGSIANSSGVINNGTFDISGTTSGATVNALTGTGTVALGGRTLTLANASGTFSGAIGGTGGLTVAGGTQTLSGVNTYTGATMVNAGTLALSGAGRLASSTSVTLAGATAALDLSAGGSQTVAHLSGVAGSRVVLGGNALTLSDDSSQTFSGSLSGTGGLVKQGAGTLTLNGVSSAFSGTTTVAGGTLAVGDAANAGAVLGGNVVVNSLGTLRGHGTVSGDVSSSGVVAPGGSIGTLSVGGNYTQAAGGTLSIEVSPTEASQLRVGGAATLNGSLAV

SEQ ID NO: 254 - protein, 606 aa, Magnetospirillum magneticum AMB-1
MSTEKTSWLKTVIEPLRPVMRELLAASLFINLMALAVPIFVMQVYDRVIGHNGTATLKGLVIGVGVLMAFDWIIRTSRGRIMQTAALRIDVEIGTKLFDKIMHLPLRTLESRPASFWQTLFRDVDSIRNTVSGSTAVLLTDLPFVLIFLGVIFIIGRPLALVFVVLFVAFLVLAWRSGGAMKESTGKEKNVQQARDGLVAEIIAGRATVKAVALDRAIRPIWEEKQAGAIEQSIQRGAVNDEYVNLGQMLTMLGSVALTTVGAVFIMDHDLTMGALVACNMLSSRLYGPINQLVGAWKSFSSFRQSVDRLGEVFAESEERRHSAIERERPSGLITLEDISFAYDQKSQAAASIDRLEIHPGGITAVLGRNGSGKTTLLKIILGLYHPAKGRVLLDGADIAQFTRAELAGWMGYVPQECVLFNASIRDNIVYGAPGASDEDILEAAKVAGVHQYIIDLPDGYGTSIGEAGSRLSAGQRQRIAIARALLGNPPVLLLDEPSASLDRQAEEDLRTTLAELGKTRTVIIVTHSPVLLPICRDVVVLDKGCVAAAGPAAETLQRLFGARPPQQPPAQPPHPQSAPQPAPHVVSQPAAPLGGGVRIGVGGVS

SEQ ID NO: 255 - protein, 564 aa, Magnetospirillum magnetotacticum
MNTEKTSWLKTVIEPLRTVMRELLAASLFINLMALAVPIFVMQVYDRVIGHNGTATLKGLVIGVAVLLAFDWIIRTSRGRIMQTAALRIDVEIGTKLFDKIMHLPLRALESRPASFWQTLFRDVDTIRNTVSGSTAILLTDLPFVLIFLGVIFVIGRPLALVFVLLFVAFLVLAWRSGGAMKESTGKEKNVQQSRDGLVAEIIAGRATVKAVALDRAIRPIWEERQAGAIEQSIQRGAVNDEYVNLGQMLTMLGSVLLTTVGAVFIMDHDLTMGALVACNMLSSRLYGPINQLVGAWKSFSSFRQSVDRLGEVFAEKEERRHSAIARERPTGLITLEDISFAYDQKSQAAASIDRLEIHPGGITAVLGRNGSGKTTLLKIILGLYHPAKGRVLLDQADIAQFTRSELAGWMGYVPQECVLFNASIRDNIVYGAPGASDEQILAAAREAGVHQYIVDLPDGYGTSIGEAGSRLSAGQRQRIAIARALLGDPPVLLLDEPSASLDRQAEEDLRNTLAELGKTHTVIIVTHSPVLLPICRDVVVLDKGSVAAAGPAAETLQRLFGAR

SEQ ID NO: 256 - protein, 588 aa, Magnetospirillum sp. SO-1
MSTEKTSWLTTVIEPLRPVMRELLAASLFINLMALAVPIFVMQVYDRVIGHNGVATLKGLVIGVGVLLAFDWIIRTSRGRIMQTAALRIDVEVGTRLFDKIMHLPLRTLESRPASFWQTLFRDVDSIRNTVSGSTAVLLTDLPFVLIFLGVIFVIGRPLAMVFILLFVAFLVLAWRSGGAMKETGDKEKNVQQARDSLVAEIIAGRATVKAVALDRAIRPIWEEKQAGAIEQSIQRGATNDEYVNMGQMLTMLGSVLLTTVGAVYIMDQQLTMGALVACNMLSSRLYGPINQLVGAWKSFASFRQSVDRLGEIFNEAEERRHSAIQRERPDGLITLEDISFAYDQKSQAASSIDRLEIRPGGITAVLGRNGSGKTTLLKIILGLYHPAKGRVLLDGADIAQFTRSELAGWMGYVPQECVLFNASIRDNIVYGCPGAGDEQILAAAKVAGVHQYIVDLPDGYGTSIGEAGSRLSAGQRQRIAIARALLGDPPVLLLDEPSASLDRQAEEDLRTTLAELGKTRTVIIVTHSPVLLPICRDVVVLDKGIVAAAGPAAETLQRLFGARPQQPPPQQQPHHPPHVVTQPAQPL

SEQ ID NO: 257 - protein, 569 aa, Phaeospirillum fulvum MGU-K5
MTEQHENWLKPILDPLRSVMRELLIASLFINLMALAVPIFVMQVYDRVIGHNGLSTLAGLTIGVALLLAFDWIIRTSRGRILQTMALRIDVDVGTRLFDKITRLPLRTLESRPTSFWQTLFRDVDTLRNTVSGATAILLTDLPFVFIFLGVIFVIGQPLALVFVLLLAAFAILAWASGRSVSEASGQEKNAQAGRDALVAEIIAGRATVKAVALDGALRPLWEERQAAAIEQSIRRGAAADGFVNLGQTLTMLGSVGLTTVGALYIIDHQLSMGALIACNMLSGRLYGPINQLVGAWKSFSAFRQSVDRLGDIFAETEERRDSAIRRERPTGRITLESVSFAYDPKLPPATRIERLEIRPGGLTAILGRNGSGKTTLLKILLGLYPPAEGRVLLDGADIAQFTRAELAGWIGYVPQECVLFNATIRDNIAYGAPGCDDEAILAAARTAGVHHYIVDLPDGYATPIGEAGSRLSAGQRQRIAIARALIGDPPVLLLDEPSASLDRQAEEELRATLAELGRSRTVVIVTHSPVLLPVCRDVVVLDKGTVTAAGPAAETLNRLFGPRPTAAP

SEQ ID NO: 258 - protein, 553 aa, Novispirillum itersonii
WFDTVLRPLLPVTRDLLSASLFINILALAGPVFVMQVYDRVVAQAGLSTLTGLVIGMGLVVIFDFTLRQMRARVMQGVAVQVDVTVGRRLFHKVLSLPLRTLESRPTAAWQQTFQDIEVLRNCLSGPTVVLLFDLPFTLLFLALIFVIAMPVAWVLVGALVAFLVIAILSARAVGSAAVKERGRKVSRDVMMAETVMGRTTVKALALERGILPLWEERQAESIERSLERGQSSDRFVNMALAVTTLTTVLMTTVGALAIVDQKMSMGALVAANMLSGRMIGPFNQLVGAWRTLQGFRQSARRLGDLFSQPEDRQTSSLSLPRPSGALTADSITFRYGAETVPTINAVKYSFRPGGITAIMGRNGCGKTTLLKLLLGLYTPEDGRVLLDGADLSQFTRAELAGWIGYVPQDCVLFSGSIRDNLTRAHPGISDADILEASTLAGAHQYIVNLPDGYATDVGEMGSLLSGGIRQRLAIARALMGKPSVLILDEPSGSLDRQAEEHLRDVLVRLSQDRTVIVVTHSPTLLSACRSIIVMDQGKIAVSGPSADVMGYL

SEQ ID NO: 259 - protein, 577 aa, Caenispirillum salinarum
SWLRPVLKPLRPAFLEVLTLSFFANLLATAVPIFTLQVYDRVVFHNGLSTLQGLVAGMVLVLAFDFVLRQTRSRVLQRVALTIDAKVGRRLFDKITALPLRTLESRRTAFWQGIFRDLDTVRNTLSGATVVLLVDLPFVVLFVGLVYVIAAPVAWVLLIAFGAFVLLAAWSAATMAKAAKAEKDKAARRDLLVAETIQGRATVKALALHRHLRPRWEDLQADTIGRSIDRGLRNDGYVNLAHVMTMATTVAMTTVGALAIMEQEMTIGALIAANMLSGRMMGPMNQVVGAWRSYAGFRQSAARLGKLFGEAEERMTAAITHDRPAGRLSLDGVGFRYRKDGQPVIHEARADVPPGGITCLMGRNGSGKTTLAKLLTGLYRPGEGRVLLDGADMAQFSREELATWIGYVPQETVLLSGSIRDAISQGTVAGEAGDEAIITAAKRACVHDIIMDMPDGYDTDVGEAGALLAGGVRQRIAIARALVTDPPVIIMDEPSSHLDTQAEQTLAQSLAALAADRNVILVTHSPVLLNAARSIIVLERGRIAAGGPAGQVMTWLQGRGAAPGQQGGAKAPETREA

SEQ ID NO: 260 - protein, 560 aa, Rhodospirillum photometricum DSM 122
KPSWLRDLLAPLFPSFREVLALSLFVNIAALATPVFSLQIYDRVVYHNGLSTLQGLAIGMAVLLVFDFIMRQARARILQTVALRLEAQVGQRLFDKMTALPLRVLESRPAEEWLRLFRDVDVVRNTLSGASALLVCDLPFTVLFLGTVFLLAPPVGWVVVVALVLFVGLALMSGRAIDQAALRERETLGGRDGLLAEIVRGRATVKALALETTLADVYRQHLAAQVQGSVRRGGLVDHFTNLGMVLSMTTTVAMTTVGALAILDHSLTVGGLIAANMLGGRLMSPLNQLMGTWRGFAGFRQSAQRLGQVLALPEDRRVSALRLPPPSGRLTVVKASFHYTPDGPPCLEEISLDLQPGGITALVGPNGSGKTTLLKLLVGLYPPASGRVLLDGADLAQFTRAELAGWIGTLPQDITLFDGTVREAIAMGHPGLDDEAVREAAQTAGVHEMILDLPQGYATRVGEGGGLLSGGMRQRLALARALAGKPPVLLLDEPSSSLDRAAEEALVETLARLATQRSVIVVTHSPLLLARCQRVVVLNKGRVLAHGPAGEILPRLFPAR

SEQ ID NO: 261 - protein, 362 aa, Magnetospirillum gryphiswaldense MSR-1
MIAGRGTVKAVALDQALRPLWEERQAGAIEHSIRRGAISDGYVNLGGALTLVANVAVTTIGAIYIIDHQLSMGALIACNMLSARLYGPINQLVGAWRGFGSFRQAVARLGETFDMAEDRSVSVIARDRPHGNLRVENVTFTYGTEPHAPATIDIPSLEFKPGGMTAILGKNGSGKTTLLKLLMGLYPPTGGRVLLDDADMAQFTRHELAAWIGYVPQETLLFNTTIRDNIAYGAPGCSDQDILEAATAAGVHSTIIDMPDGYATTIGEAGSRLSAGQRQRIAIARALVGNPAVLLLDEPSASLDRHAEEDLRAALQAMAATRTVVVVTHSAVLLPACRDVVVLDKGKLAARGPAAEVLPRLF

SEQ ID NO: 262 - protein, 557 aa, Glaciecola sp. HTCC2999
QAQTWFDAIFEPLRPAYKQTLLMAFGINIIGLFASIFALQVYDRVIAKGGHNTLIALASGMAIAILVEFILRGGRSALMRRIGSRIEISIARTVYKRLADMPLIELEARSPAFWQAMFRDIELVRSVMAGAPALLLIDLPFIVLTLILLSIIAPPLLVLALAIMSAFMFLAWRSEKVMRNAAADEKALMINRDAVLSDLTASRRHLKAVGPSASLNLKWETQYAQWMENSVDRSEESDRYRDMSQSLMVSSTVLMTSFGAIAIMNQLMTMGALIAANILTGKLTSPMVQLVSQWRTFGQFNLARDRLNELFSVPLDRTVSPVAMARPEGQLTLDKVSFAYPQSESNQINEVSGRLGATGLHVIVGNNGSGKTTLLKLMRGLYAPSAGRILIDGSDIKQFGQQDLAKWIGYLPQQPRLVQGTIKENLLLASTDITDEELVTICKLAGAFEFITSLPDGFDTEVGEAGSRFSSGQRKRIAIAQTLMQSPPIILFDEPTSDLDREAEQAFIAQMKLLARDRTVIVVSHSPVLLQQADGIVVLQNGRVAAAGLAKDVLPKL

SEQ ID NO: 263 - protein, 573 aa, Limnobacter sp. MED105
VIRSALPLLKRAALLSIFVNLVALFPAVFSLQVYDRVIYRSGLNTLTALLIGMGILLAADLILRSFRARVLRVAAVKIDGQIASKLMNKILSIPLRQLEARSTAAWYSLFKDVDTVRVVWSGAVAMTILDLPFAILAIGLIATIALPVLPVVLIGLVCLAALSWYSSGEFRKRRVEEFSRARRRDEVLAEVCRGREAIKSLVQDDSAKRAWVSSYNSWVQESFQKNGEMEDQRELSVSIMLCVNVAITAVGAYAVINQWMTVGGLIASNMLAAKAIGPLAALTGHWRSIAHSREATDRLNKVFAADEEKQHTGLSLPMPSGALRLENVSYQHVGAQKEVVKSVSAQIGPRGIYGLAGDNGAGKSTLLKLLRGLYEPQSGRVLLDEYDLSQFSRQELAKWIGFLPQTSQLFEGTIVENLRRSNPDASDEQILLAAKRSGAHEFIAKMPDGYMTQVGEGGNRLSGGQRRRVAITQAFLSDAPVLLLDEPTNDLDFAAETHLMAVFKSLATVKTIIMVTHSVRLMSICDKIIYLDKASKLHVGATPEMLKLLYGISVPKPVPAAPKAASQVTSEAA

SEQ ID NO: 264 - protein, 568 aa, Pseudomonas stutzeri
VDTSDGDWLHVLLQPLRPAYRQALMLAGLVNLIALGTAVYSLQVYDRVVAHGGYSSLVALTVGMLIAIAFDHLLRAGRAQLLQRVGLQIEVAIARSAFERLLALPATVLESRPPAYWQTVFRDIELVRATWSGATALLLVDLPFLVLALALLALIALPLLPVALCVIAAFVVLAWRSGRVTRDAAESEREKLVGRDAAISELAHARMLLKAIGAQQSAHARWEKNYAEWMSEAAGRSRDGDHYRDVAHGMSTLATIAITGAGALAILANLMTMGALIAANILTGRMIAPLVQLVGQWKQFGQYRAARKRLDALFATHAERATTAVALPRPQGTLILDGLSFRYPRCEHDQIQDISGQIGPHGLHAIVGANGSGKSTLLKLLRGLYRPAAGRVLLDGGDLAQFGQQDLARWIGYLPQQVQLISGSVRDNIALADPGITDEAILLAAQRACAHDFILNLPDGYATEVGEGGGRFSGGEKKRIAIAQLLLRDPPILLLDEPTADLDREAEQAFIATLRALAADHTVLVVSHSLAVLSQCNGILMLEKGRLKAAGPARQILPALGFGEPAPQ

SEQ ID NO: 265 - protein, 547 aa, Osedax symbiont Rs1
IYRDVLIASFLINLFVLANPLFVMNVYDRVVPNSAIETLWVLAIGVFVVYAFDFGLKMLRAYFLEIAGKKADILMSAMLFEKVMSMQYAFMPKSVGSFASNLREFESIRGFLSSTTTTVLIDIPFAVIFLIVMFLIGGPLVYVPLVAIPIILIYSLIASKKLKESVEQTFAASAQKNSTLIECLTAMETVKTQRASSVLQLRWEQAEGFIAKWSLKSKMISSSVTNFAGFVTQLSSVCLVIVGVYLISERELTMGALIAANILSGRVLQPMAQVTGLVTSFFQSKTALASLNQIMELPDERAEGKNYVHRPDLYGAIDFKAVKFSYPEAEQVSLDKIDFSIKSGEKVALIGRIGSGKSTIEKLLMGLYKPEEGAVRIDGIDLNQIDPVDLRRNIGYVPQELMLFDGTVRDNIIMGSPEIDDDSLIKAAAIAGVDQFVNRHPLGFEMPVGERGARLSGGQKQAIAIARALIHSPNILILDEPTNSMDNSSEDFLRKQLSKYCQDRTLILVTHKMSLLSLVERIIVMDSGRVVADGPKDVVLDALKQGR

SEQ ID NO: 266 - protein, 563 aa, Thauera sp. 28
TRAGHWFWSVMAENRALYRDVLLAALVINVFALALPLFSMNVYDRVVPNNAIETLWALAIGVMIVICGDFVLRMLRGYFVDLAGSRADVKLSAVIMEKVLGLRMEARPDSAGSFASNLRAFESVRDFISSATVTAFIDLPFALLFVIVIGWIGWPMVIPFVVGITLLLLYSLTVQRRMHALAETTYRASAQRNATLVEGLVGMETVKAMGAEAVIQGKWEKSAALVASVGARLRLLAATSSNGALWVQQMVSLSTVIIGVYLISEGELTMGGLIACYLLSSRAMAPIGQVAGLLVQYHSAATAFESLEELMQRPVERPQDKRFLSRPLLRGDIEFRNVSFAYGEGEMPALREVSFTIRTGERVGILGRVGSGKTTLEKLILGLYQPTGGAVLVDGIDLRQLDPAELRRNIGYVPQDVTLFYGSLRDNIVIGMPEAGDDKVLRAARIAGIADFVDAHPHGYGMLVGERGESLSGGQRQGVAIARALVADPPILLLDEPSASMDHASEEALKQQLRAHGAGKTLIVITHRTSLLDLVDRIIVIDAGRIVADGPKAQVVDALRQGR

SEQ ID NO: 267 - protein, 563 aa, Thauera sp. 27
TRAGHWFWSVMAENRALYRDVLLAALVINVFALALPLFSMNVYDRVVPNNAIETLWALAIGVMIVICGDFVLRMLRGYFVDLAGSRADVKLSAVIMEKVLGLRMEARPDSAGSFASNLRAFESVRDFISSATVTAFIDLPFALLFVIVIGWIGWPMVIPFVVGITLLLLYSLTVQRRMHALAETTYRASAQRNATLVEGLVGMETVKAMGAEAVIQGKWEKSAALVASVGARLRLLAATSSNGALWVQQMVSLSTVIIGVYLISEGELTMGGLIACYLLSSRAMAPIGQVAGLLVQYHSAATAFESLEELMQRPVERPQDKRFLSRPLLRGDIEFRNVSFAYGEGEMPALREVSFTIRAGERVGILGRVGSGKTTLEKLILGLYQPTGGAVLVDGIDLRQLDPAELRRNIGYVPQDVTLFYGSLRDNIVIGMPEAGDDKVLRAARIAGIADFVDAHPHGYGMLVGERGESLSGGQRQGVAIARALVADPPILLLDEPSASMDHASEEALKQQLRAHGAGKTLIVITHRTSLLDLVDRIIVIDAGRIVADGPKAQVVDALRQGR

SEQ ID NO: 268 - protein, 562 aa, Thioalkalivibrio sp. ALgr5
DKGHWFWRVIRENRPLYRDVLVAAVMINLFALAMPLFVLNVYDRVVPNHATETLFMFAAGVVIVLIADLVLRTMRSHFVDKAAMRADVKLSSHIMERVLGLRMENRPASVGSFASNIGAFESVRSFISSATIIAFVDLPFSLLFIAIIALIAWPLAVPVLIGALVLLLYATAIHRKLHALAEESYRVAAQRNSTLVESLAGAETLKALSAEGRVQATWERSTAHLARTSAQNRLLTASVTHTALWAQHTVGVAIIVLGVFLLMEGDLSMGGLIAAYLISSRAMAPISQTAGLLMQYHQASTALGSLNEIMTLPVERPPETTFLSRDRFEGAIEFRNVDFAYPEQPNPALRNVSLRIQPGEHVAILGRVGSGKSTLAKLIMGLYQPTGGAVMVDGIDVRQLDPAELRRSMGYVGQEVTLFYGSLRENLVASDPLASDEAIRKAIAISGIEDLINTHPQGIDMQVGERGGRLSGGQKQSVGVARAVLHEPNMLLLDEPTSSMDNSTEQAMKRRLAEFMEGRTAVIVTHRTSLLELVDRIIVLDQGRVVADGPKDQVVQALREGR

SEQ ID NO: 269 - protein, 476 aa, Pseudomonas fluorescens
MGVFDYKNLGTEASKTLFADATAITLYTYHNLDNGFAVGYQQHGLGLGLPATLVGALLGSTDSQGVIPGIPWNPDSEKAALDAVHAAGWTPISASALGYGGKVDARGTFFGEKAGYTTAQAEVLGKYDDAGKLLEIGIGFRGTSGPRESLITDSIGDLVSDLLAALGPKDYAKNYAGEAFGGLLKTVADYAGAHGLSGKDVLVSGHSLGGLAVNSMADLSTSKWAGFYKDANYLAYASPTQSAGDKVLNIGYENDPVFRALDGSTFNLSSLGVHDKAHESTTDNIVSFNDHYASTLWNVLPFSIANLSTWVSHLPSAYGDGMTRVLESGFYEQMTRDSTIIVANLSDPARANTWVQDLNRNAEPHTGNTFIIGSDGNDLIQGGKGADFIEGGKGNDTIRDNSGHNTFLFSGHFGQDRIIGYQPTDRLVFQGADGSTDLRDHAKAVGADTVLSFGADSVTLVGVGLGGLWSEGVLIS

SEQ ID NO: 270 - protein, 60 aa, Magnetospirillum gryphiswaldense MSR-1
THVDGGDGNDTLTTGSGADELTGGEGADILTGGGGRDTFVLSAADTIADYSPHDKMVVRG

SEQ ID NO: 271 - protein, 96 aa, Magnetospirillum gryphiswaldense MSR-1
ANAETITVNSSATINNGRSFLSYDLFDGVDVFTDTGAAATHVDGGDGNDTLTTGSGADELTGGEGADILTGGGGRDTFVLSAADTIADYSPHDKMV

SEQ ID NO: 272 - protein, 55 aa, Magnetospirillum magneticum AMB-1
SGNDVLDGGSGNDQIHGGAGNDTIIGGTGDDVMFGDQGNDTFLFDFGFGHDVVDG

SEQ ID NO: 273 - protein, 55 aa, Magnetospirillum magneticum AMB-1; identical to SEQ ID NO: 272

SEQ ID NO: 274 - protein, 19 aa, Magnetospirillum magneticum AMB-1
GNDDIIGTNGNDLLLGGKG

SEQ ID NO: 275 - protein, 54 aa, Magnetospirillum magnetotacticum
GNDILDGGAGNDQIHGGGGNDTITGGTGDDVMFGDQGSDTFLFDFGFGHDVVDG

SEQ ID NO: 276 - protein, 80 aa, Magnetospirillum magnetotacticum
NVAVTTLDGTSTAVTNSSFNVSFSGGFNDTITGGAGADTMYGGAGNDTFKVSGATESVGDIYDGGSGVDTILGSSGADVI

SEQ ID NO: 277 - protein, 23 aa, Magnetospirillum magnetotacticum
GNDVITGSAGADTILTGTGDDTV

SEQ ID NO: 278 - protein, 73 aa, Magnetospirillum sp. SO-1
GNDTLTGSAGNDLMDGGAGNDVLNGVAGADTVLGGTGNDTIDAGAGDDLLSGGAGADRLTGDSGIDTASYSGS

SEQ ID NO: 279 - protein, 67 aa, Magnetospirillum sp. SO-1
IENLTGGTAADVLTGDAGVNVIDGGAGNDTLGGAAGADTLVGGAGNDALDGGDGNDLLSGGAGADTL

SEQ ID NO: 280 - protein, 48 aa, Magnetospirillum sp. SO-1
DVLTGDAGVNVIDGGAGNDTLGGAAGADTLVGGAGNDALDGGDGNDLL

SEQ ID NO: 281 - protein, 41 aa, Magnetospirillum sp. SO-1
LLQGGGGADTLDGAAGNDVLRGGAGADTLAGGAGTDTVTYS

SEQ ID NO: 282 - protein, 54 aa, Magnetospirillum magnetotacticum
NVTVQGSQGNDIINGGNAGEFLWGDQGNDTIAGGQGNDTILGGAGTDVAVFTGA

SEQ ID NO: 283 - protein, 39 aa, Magnetospirillum magnetotacticum
ITGTTGNDTLVGGAGDDTLAGGAGTNTLSGGSGSDTFVL

SEQ ID NO: 284 - protein, 48 aa, Magnetospirillum magnetotacticum
NAAPRTTGLTLIGGAGNDQFLGSLGNDTITGGGGTNSMDGGGGTDTVS

SEQ ID NO: 285 - protein, 41 aa, Magnetospirillum magnetotacticum
DLQFDITGTTGNDTLVGGAGDDTLAGGAGTNTLSGGSGSDT

SEQ ID NO: 286 - protein, 103 aa, Magnetospirillum magnetotacticum
HSTSASNVVDTDFFGISGADTLVFEVATGTQSVTLDAYAASAGVTRIDASGASGGVANTGGVTVNASAYSTAVSISGGSGADTFTGGSGADSFVGGGGNDVIH

SEQ ID NO: 287 - protein, 6 aa, Artificial Sequence
  synthetic construct
  misc_feature (3)..(3): Xaa can be any naturally occurring amino acid
  misc_feature (5)..(5): Xaa can be any naturally occurring amino acid
GGXGXD

SEQ ID NO: 288 - protein, 1377 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 289 - protein, 1250 aa, Escherichia coli
MRIIFLRKEYLSLLPSMIASLFSANGVAAVTDSCQGYDVKASCQASRQSLSGITQDWSIADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIVNNTAFTNNTAEGYGGAIYTNSVTAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDQYQNQAELNVGSTQQTFVHALTGFQNGTLNIDAGGNVTVNQGSFAGIIEGAGQLTIAQNGSYVLAGAQSMALTGDIVVDDGAVLSLEGDAADLTALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITSDVDTRSDAAGHGRDIEMRADGEVAVDAGVDTQWGALMADSSGQHQDEGSTLTKTGAGTLELTASGTTQSAVRVEEGTLKGDVADILPYASSLWVGDGATFVTGADQDIQSIDAISSGTIDISDGTVLRLTGQDTSVALNASLFNGDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTPDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSNMTGTRADNQNHGYAVGLTSSWFQHGNQKQGAWLDSWLQYAWFSNDVSEQEDGTDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDGSTISDDAVKQRGEIKVGVTGNISQRVSLRGSVAWQKGSDDFAQTAGFLSMTVKW

SEQ ID NO: 290 - protein, 15 aa, Agrobacterium tumefaciens
  misc_feature (2)..(8): Xaa can be any naturally occurring amino acid
  misc_feature (10)..(10): Xaa can be any naturally occurring amino acid
  misc_feature (12)..(12): Xaa can be any naturally occurring amino acid
  misc_feature (14)..(15): Xaa can be any naturally occurring amino acid
RXXXXXXXRXRXRXX

SEQ ID NO: 291 - protein, 200 aa, Magnetospirillum magneticum AMB-1
DSGTGWIWDPTLNGTSLSVTAHAATTVNGNSTYNGGATADYVIGLGQNEMVHLGGGADVYAGHGSYNTIGVSDMNFHFLDGGAGGGNTLQWENLNNQAFDLTGLWNNAVQNFDVLDLSHANNNNAVLDLAHLQSMLNGTNAVTGTGNALVVIGGNSVTLAGSGWQANGTAELTVNGQHDSYTQYSNGDTHVYVENHTHVG

SEQ ID NO: 292 - protein, 218 aa, Escherichia coli
GNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 293 - protein, 104 aa, Pseudomonas fluorescens
GSDGNDLIQGGKGADFIEGGKGNDTIRDNSGHNTFLFSGHFGQDRIIGYQPTDRLVFQGADGSTDLRDHAKAVGADTVLSFGADSVTLVGVGLGGLWSEGVLIS

SEQ ID NO: 294 - protein, 220 aa, Magnetospirillum magneticum AMB-1
GAIGGAGAIPGITLVGNAGNDDIIGTNGNDLLLGGKGGATYRFSGGGCGSGGGWSIVQSDTNDVISAGAGDDVIYGDARLVNGNIQITGSGNDVLDGGSGNDQIHGGAGNDTIIGGTGDDVMFGDQGNDTFLFDFGFGHDVVDGGRGSNWTDTLDLTHDNQISSVNIEGVSGWAVSVDAQGHHVAQATNGAHDANGTIVVTNHDGSQDTIEFHNVEKVVW

SEQ ID NO: 295 - protein, 226 aa, Xanthomonas oryzae
MLMGMSEEHPSNVQIDDAQRVRLLRAVFDAYYQNRQELGTVFDTNRAWCSRLTGLARLFPRSRMICCVRDVGWIVDSFERLAQSQPLRLSALFGYDPEDSVSMHADLLTAPRGVVGYALDGLRQAFYGDHADRLLLLRYDTLAQRPAQAMEQVYAFLQLPAFAHDYAGVQAEAERFDAALQMPGLHRVRRGVHYVPRRSVLPPALFDQLQELAFWESAPSHGALLV

SEQ ID NO: 296 - protein, 1250 aa, Escherichia coli; identical to SEQ ID NO: 289

SEQ ID NO: 297 - protein, 1039 aa, Escherichia coli
MKRHLNTCYRLVWNHMTGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFVRLEGDLMRTEVAGMSVTAGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 298 - protein, 457 aa, Escherichia coli
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFKNWFEKESGDISNHQIEQIFDKDGRVITPDSLKKALEYQQSNNKASYVYGNDALAYGSQGNLNPLINEISKIISAAGNFDVKEERAAASLLQLSGNASDFSYGRNSITLTASA

SEQ ID NO: 299 - protein, 265 aa, Helicobacter pylori
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLARAELARAPAPRQRGMDRGGPDFSM

SEQ ID NO: 300 - protein, 289 aa, Agrobacterium tumefaciens
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKISALDRTARLISTSPSKARSKAETEKAIDELDDRRVYDPRDRAQDKAFKR

We claim:

1. An isolated host cell comprising an artificial endosymbiont, wherein the artificial endosymbiont secretes a heterologous protein into the host cell and thereby provides a phenotype to the host cell.

2. The host cell of claim 1, wherein the protein is a selectable marker.

3. The host cell of claim 1, wherein the protein is a reporter protein.

4. The host cell of claim 3, wherein the reporter protein is a green fluorescent protein.

5. The host cell of claim 1, wherein the artificial endosymbiont is an α-proteobacterium.

6. The host cell of claim 1, wherein the artificial endosymbiont is a magnetotactic bacterium.

7. The host cell of claim 1, wherein the host cell is a mammalian cell.

8. The host cell of claim 7, wherein the mammalian cell is selected from the group consisting of a mouse cell, a rat cell, a rabbit cell, a hamster cell, a porcine cell, a bovine cell, a feline cell, a canine cell or a human cell.

9. A method for introducing a phenotype into a host cell, comprising the steps of: culturing a host cell comprising an artificial endosymbiont, wherein the artificial endosymbiont expresses a secreted protein encoded by a heterologous nucleic acid and wherein the protein is secreted into the host cell and produces a phenotype in the host cell.

10. The method of claim 9, wherein the protein is a selectable marker.

11. The method of claim 9, wherein the protein is a reporter protein.

12. The method of claim 11, wherein the reporter proteins is a GFP.

13. The method of claim 9, wherein the artificial endosymbiont comprises an α-proteobacterium.

14. The method of claim 9, wherein the artificial endosymbiont comprises a magnetotactic bacterium.

15. The method of claim 9, wherein the host cell comprises a mammalian cell.

16. The method of claim 15, wherein the mammalian cell is selected from mouse, rat, rabbit, hamster, porcine, bovine, feline, canine or human cell.

17. The host cell of claim 3, wherein the reporter is an optical reporter.

18. The host cell of claim 3, wherein the reporter is a bioluminescent reporter.

19. The host cell of claim 3, wherein the reporter is a fluorescent reporter.

20. The host cell of claim 7, wherein the mammalian cell is a cancer cell or a stem cell.

21. The host cell of claim 20, wherein the stem cell is selected from the group consisting of an embryonic stem cell, an induced pluripotent stem cell, a mesenchymal cell, and an adult stem cell.

22. The host cell of claim 20, wherein the stem cell is a neural stem cell or a neural progenitor cell.

23. The host cell of claim 21, wherein the stem cell is a mesenchymal cell.

24. The host cell of claim 21, wherein the stem cell is an induced pluripotent cell.

25. The host cell of claim 20, wherein the cancer cell is a leukemia cell or a lymphoma cell.

26. The host cell of claim 20, wherein the cancer cell is a solid tumor cell.

27. The host cell of claim 26, wherein the cancer cell is selected from the group consisting of a colon tumor cell, a CNS tumor cell, a brain tumor cell, a renal tumor cell, a melanoma tumor cell, an ovarian tumor cell, a breast tumor cell, and a prostate tumor cell.

28. The host cell of claim 20, wherein the cancer cell has been given a drug treatment.

* * * * *